United States Patent
Barnhart et al.

(10) Patent No.: US 9,845,484 B2
(45) Date of Patent: Dec. 19, 2017

(54) 3-HYDROXYPROPIONIC ACID PRODUCTION BY RECOMBINANT YEASTS EXPRESSING AN INSECT ASPARTATE 1-DECARBOXYLASE

(71) Applicant: Novozymes A/S, Bagsvaerd (DK)

(72) Inventors: Michelle Barnhart, Sacramento, CA (US); Ana Negrete-Raymond, Chanhassen, MN (US); Janice Frias, Sacramento, CA (US); Gui Barbier, Davis, CA (US); Michael Catlett, West Sacramento, CA (US)

(73) Assignee: NOVOZYMES A/S, Bagsvaerd (DK)

(*) Notice: Subject to any disclaimer, the term of this patent is extended or adjusted under 35 U.S.C. 154(b) by 0 days.

(21) Appl. No.: 14/908,730

(22) PCT Filed: Jul. 31, 2014

(86) PCT No.: PCT/US2014/049286
§ 371 (c)(1),
(2) Date: Jan. 29, 2016

(87) PCT Pub. No.: WO2015/017721
PCT Pub. Date: Feb. 5, 2015

(65) Prior Publication Data
US 2016/0168600 A1    Jun. 16, 2016

Related U.S. Application Data

(60) Provisional application No. 61/860,550, filed on Jul. 31, 2013, provisional application No. 61/976,139, filed on Apr. 7, 2014.

(51) Int. Cl.
*C12P 7/42* (2006.01)
*C12P 7/40* (2006.01)
*C12N 1/00* (2006.01)
*C07H 21/04* (2006.01)
*C07K 1/00* (2006.01)
*C12N 1/16* (2006.01)
*C12N 9/88* (2006.01)

(52) U.S. Cl.
CPC .......... *C12P 7/42* (2013.01); *C12N 1/16* (2013.01); *C12N 9/88* (2013.01); *C12P 7/40* (2013.01); *C12Y 401/01011* (2013.01); *C12Y 401/01001* (2013.01)

(58) Field of Classification Search
CPC .... C12N 1/16; C12N 9/88; C12Y 401/01001; C12Y 401/01011; C12P 7/40; C12P 7/42
USPC .......... 435/146, 136, 254.11, 254.2, 254.21, 435/254.22, 254.23; 536/23.1, 23.2; 530/350
See application file for complete search history.

(56) References Cited

FOREIGN PATENT DOCUMENTS

| WO | 2012074818 A2 | 6/2012 |
| WO | 2012158296 A1 | 11/2012 |
| WO | 2014057036 A1 | 4/2014 |

OTHER PUBLICATIONS

Broun et al., Catalytic plasticity of fatty acid modification enzymes underlying chemical diversity of plant lipids. Science, 1998, vol. 282: 1315-1317.*
Chica et al., Semi-rational approaches to engineering enzyme activity: combining the benefits of directed evolution and rational design. Curr. Opi. Biotechnol., 2005, vol. 16: 378-384.*
Devos et al., Practical limits of function prediction. Proteins: Structure, Function, and Genetics. 2000, vol. 41: 98-107.*
Seffernick et al., Melamine deaminase and Atrazine chlorohydrolase: 98 percent identical but functionally different. J. Bacteriol., 2001, vol. 183 (8): 2405-2410.*
Sen et al., Developments in directed evolution for improving enzyme functions. Appl. Biochem. Biotechnol., 2007, vol. 143: 212-223.*
Whisstock et al., Prediction of protein function from protein sequence. Q. Rev. Biophysics., 2003, vol. 36 (3): 307-340.*
Witkowski et al., Conversion of b-ketoacyl synthase to a Malonyl Decarboxylase by replacement of the active cysteine with glutamine. Biochemistry, 1999, vol. 38: 11643-11650.*
GenBank NCBI: XM_001658385.1; 3 pages downloaded from https://www.ncbi.nlm.nih.gov on Apr. 25, 2017.*
Agnello et al., 2013, ACS Chem. Biol., 8, 2264-2271.
Arakane et al, 2009, J Biol Chem 284(24), 16584-16558.
Liu, 2012, Insect Biochemistry and Mol Biol 42, 396-403.

* cited by examiner

*Primary Examiner* — Ganapathirama Raghu
(74) *Attorney, Agent, or Firm* — Eric J. Fechter

(57) ABSTRACT

Provided herein are recombinant yeast cells having an active 3-Hydroxypropionic Acid (3-HP) pathway and further comprising a heterologous polynucleotide encoding an aspartate 1-decarboxylase (ADC) of the Class Insecta, Bivalvia, Branchiopora, Gastropoda, or Leptocardii. Also described are methods of using the recombinant yeast cells to produce 3-HP and acrylic acid.

20 Claims, 29 Drawing Sheets

Fig. 22

3-HYDROXYPROPIONIC ACID PRODUCTION BY RECOMBINANT YEASTS EXPRESSING AN INSECT ASPARTATE 1-DECARBOXYLASE

CROSS-REFERENCE TO RELATED APPLICATIONS

This application is a 35 U.S.C. 371 national application of PCT/US2014/049286, filed Jul. 31, 2014, which claims priority or the benefit of U.S. provisional application No. 61/860,550, filed Jul. 31, 2013, and U.S. provisional application No. 61/976,139, filed Apr. 7, 2014. The contents of these applications are fully incorporated herein by reference.

REFERENCE TO A SEQUENCE LISTING

This application contains a Sequence Listing in computer readable form, which is incorporated herein by reference.

BACKGROUND

Concerns related to the future supply of oil have prompted research in the area of renewable energy and renewable sources of other raw materials. Biofuels (e.g., ethanol) and bioplastics (e.g., polylactic acid) are examples of products that can be made directly from agricultural sources using microorganisms. Additional desired products may then be derived using non-enzymatic chemical conversions, e.g., dehydration of ethanol to ethylene.

3-Hydroxypropionic acid (3-HP) is a three carbon carboxylic acid identified by the U.S. Department of Energy as one of the top 12 high-potential building block chemicals that can be made by fermentation. Alternative names for 3-HP, which is an isomer of lactic (2-hydroxypropionic) acid, include ethylene lactic acid and 3-hydroxypropionate. 3-HP is an attractive renewable platform chemical, with 100% theoretical yield from glucose, multiple functional groups that allow it to participate in a variety of chemical reactions, and low toxicity. 3-HP can be used as a substrate to form several commodity chemicals, such as 1,3-propanediol, malonic acid, acrylamide, and acrylic acid. Acrylic acid is a large-volume chemical (>7 billion lbs/year) used to make acrylate esters and superabsorbent polymers, and is currently derived from catalytic oxidation of propylene. Fermentative production of 3-HP would provide a sustainable alternative to petrochemicals as the feedstock for these commercially-significant chemicals, thus reducing energy consumption, U.S. dependence on foreign oil, and the production of greenhouse gases.

Bacteria can be used to ferment sugars to organic acids. However, bacteria present certain drawbacks for large-scale organic acid production. As organic acids are produced, the fermentation medium becomes increasingly acidic. Lower pH conditions are actually preferable, because the resultant product is partially or wholly in the acid form. However, most bacteria that produce organic acids do not perform well in strongly acidic environments, and therefore either die or begin producing so slowly that they become economically unviable as the medium becomes more acidic. To prevent this, it becomes necessary to buffer the medium to maintain a higher pH. However, this makes recovery of the organic acid product more difficult and expensive.

There has been increasing interest in recent years around the use of yeast to ferment sugars to organic acids. Yeasts are used as biocatalysts in a number of industrial fermentations, and present several advantages over bacteria. While many bacteria are unable to synthesize certain amino acids or proteins that they need to grow and metabolize sugars efficiently, most yeast species can synthesize their necessary amino acids or proteins from inorganic nitrogen compounds. Yeasts are also not susceptible to bacteriophage infection, which can lead to loss of productivity or whole fermentation runs in bacteria.

Although yeasts are attractive candidates for organic acid production, they present several difficulties. First, pathway engineering in yeast is typically more difficult than in bacteria. Enzymes in yeast are compartmentalized in the cytoplasm, mitochondria, or peroxisomes, whereas in bacteria they are pooled in the cytoplasm. This means that targeting signals may need to be removed to ensure that all the enzymes of the biosynthetic pathway co-exist in the same compartment within a single cell. Control of transport of pathway intermediates between the compartments may also be necessary to maximize carbon flow to the desired product. Second, not all yeast species meet the necessary criteria for economic fermentation on a large scale. In fact, only a small percentage of yeasts possess the combination of sufficiently high volumetric and specific sugar utilization with the ability to grow robustly under low pH conditions. The U.S. Department of Energy has estimated that production rates of approximately 2.5 g/L/hour are necessary for economic fermentations of several organic acids, including, for example, 3-HP.

Although many yeast species naturally ferment hexose sugars to ethanol, few if any naturally produce significant yields of organic acids. This has led to efforts to genetically modify various yeast species to produce organic acids. Genetically modified yeast strains that produce lactic acid have been previously developed by disrupting the endogenous pyruvate decarboxylase (PDC) gene and inserting a lactate dehydrogenase (LDH) gene to eliminate ethanol production (see, e.g., WO 99/14335, WO 00/71738, WO 02/42471, WO 03/049525, WO 03/102152, and WO 03/102201). This alteration diverts sugar metabolism from ethanol production to lactic acid production. The fermentation products and pathways for yeast differ from those of bacteria, and thus different engineering approaches are necessary to maximize yield. Other native products that may require elimination or reduction in order to enhance organic acid product yield or purity are glycerol, acetate, and diols. The reduction of glycerol in genetically altered yeast strains is described in, for example, WO 07/106524.

Unlike lactic acid, 3-HP is not a major end product of any pathway known in nature, being found in only trace amounts in some bacteria and fungi. Thus, a greater deal of genetic engineering is necessary to generate yeast that produce 3-HP. A *Saccharomyces cerevisiae* strain was previously engineered to produce 3-HP at very low levels through a lactate intermediate (see WO 02/042418). However, the tolerance level of wild-type *S. cerevisiae* is insufficient to make it an optimal host for 3-HP production. Yeast cells that are highly tolerant to 3-HP are described in WO 2012/074818. However, there is still a need in the art to further improve 3-HP production in a more cost-effective manner on an industrial scale.

SUMMARY

The Applicant has surprisingly found that expression of an aspartate 1-decarboxylase (ADC) of the Class Insecta (insect) in a yeast host results in significantly improved metabolic 3-HP production. Accordingly, in one aspect is a recombinant yeast cell comprising an insect aspartate 1-decarboxylase (ADC), such as the *Aedes aegypti* ADC of SEQ ID NO: 162, the *Culex quinquefasciatus* ADC of SEQ ID NO: 163, the *Anopheles gambiae* ADC of SEQ ID NO: 164, the *Tribolium castaneum* ADC of SEQ ID NO: 165, the *Attagenus smirnovi* ADC of SEQ ID NO: 166, the *Acyrthosiphon pisum* ADC of SEQ ID NO: 167, the *Drosophila sechellia* ADC of SEQ ID NO: 168, the *Drosophila melanogaster* ADC of SEQ ID NO: 169, the *Danaus plexippus* ADC of SEQ ID NO: 170, the *Drosophila yakuba* ADC of SEQ ID NO: 171, the *Drosophila erecta* ADC of SEQ ID NO: 172, the *Papilio xuthus* ADC of SEQ ID NO: 173, the *Drosophila persimilis* ADC of SEQ ID NO: 174, the *Bombyx mori* ADC of SEQ ID NO: 175, the *Drosophila ananassae* ADC of SEQ ID NO: 176, the *Drosophila mojavensis* ADC of SEQ ID NO: 177, the *Drosophila grimshawi* ADC of SEQ ID NO: 178, the *Biston betularia* ADC of SEQ ID NO: 179, the *Drosophila willistoni* ADC of SEQ ID NO: 180, the *Apis mellifera* ADC of SEQ ID NO: 181, the *Drosophila virilis* ADC of SEQ ID NO: 182, the *Nasonia vitripennis* ADC of SEQ ID NO: 183, the *Bicyclus anynana* ADC of SEQ ID NO: 184, the *Harpegnathos saltator* ADC of SEQ ID NO: 185, the *Acromyrmex echinatior* ADC of SEQ ID NO: 186, the *Camponotus floridanus* ADC of SEQ ID NO: 187, the *Pediculus humanus* ADC of SEQ ID NO: 188, the *Atta cephalotes* ADC of SEQ ID NO: 189, the *Meligethes aeneus* ADC of SEQ ID NO: 190, or the *Solenopsis invicta* ADC of SEQ ID NO: 191. In another aspect is a recombinant yeast cell comprising an aspartate 1-decarboxylase (ADC) of the Class Bivalvia, Branchiopoda, Gastropoda, or Leptocardii, such as the *Daphnia pulex* ADC of SEQ ID NO: 192, the *Lottia gigantea* ADC of SEQ ID NO: 193, the *Branchiostoma floridae* ADC of SEQ ID NO: 194, or the *Crassostrea gigas* ADC of SEQ ID NO: 195. In another aspect is a recombinant yeast cell comprising an aspartate 1-decarboxylase (ADC) having at least 60% sequence identity to SEQ ID NO: 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, or 195, wherein the cell is capable of producing 3-HP. In another aspect is a recombinant yeast cell comprising an aspartate 1-decarboxylase (ADC) comprising a glutamine at a position corresponding to position 377 of the amino acid sequence of SEQ ID NO: 162, and a partial amino acid sequence having at least 60% sequence identity to amino acids 382-516 of SEQ ID NO: 162, wherein the cell is capable of producing 3-HP.

In some aspects, the recombinant yeast cells produce a greater amount of 3-HP compared to the cells without the heterologous polynucleotide encoding the aspartate 1-decarboxylase (ADC) when cultivated under identical conditions.

In some aspects, the recombinant yeast cells further comprise one or more (e.g., two, several) heterologous polynucleotides selected from a heterologous polynucleotide encoding a PPC, a heterologous polynucleotide encoding a PYC, a heterologous polynucleotide encoding an AAT, a heterologous polynucleotide encoding a BAAT or gabT, and a heterologous polynucleotide encoding a 3-HPDH.

In some aspects, the recombinant yeast cells comprise a disruption of one or more endogenous genes encoding a PDC, ADH, GALE, CYB2A, CYB2B, GPD, GPP, ALD, or PCK. In some embodiments, the recombinant yeast cells comprise a disruption of one or both of an endogenous gene encoding a PDC and an endogenous gene encoding a GPD.

In some aspects, the yeast cell is a *Candida*, *Issatchenkia*, *Kluyveromyces*, *Pichia*, *Saccharomyces*, *Schizosaccharomyces*, *Torulaspora*, or *Zygosaccharomyces* yeast cell. In some embodiments, the yeast cell is an *I. orientalis* yeast cell, e.g., *I. orientalis* CNB1 yeast cell. In some embodiments, the recombinant yeast cell is a 3-HP-resistant yeast cell. In some embodiments, the cell is unable to ferment pentose sugars.

Also described are methods of producing 3-HP and related compounds. In one aspect is a method of producing 3-HP, comprising: (a) cultivating a recombinant yeast cell described herein in a medium under suitable conditions to produce 3-HP; and (b) recovering the 3-HP. In another aspect is a method of producing acrylic acid or a salt thereof, comprising: (a) cultivating a recombinant yeast cell described herein in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

BRIEF DESCRIPTION OF THE FIGURES

FIG. 22 shows a multiple sequence alignment for the insect ADCs of SEQ ID NOs: 162 (*Aedes aegypti*), 169 (*Drosophila melanogaster*), 170 (*Danaus plexippus*), and 181 (*Apis mellifera*).

FIG. 24 shows a plasmid map of pMHCT259a.

FIG. 26 shows a plasmid map of pMHCT260a.

DEFINITIONS

Figure 1:
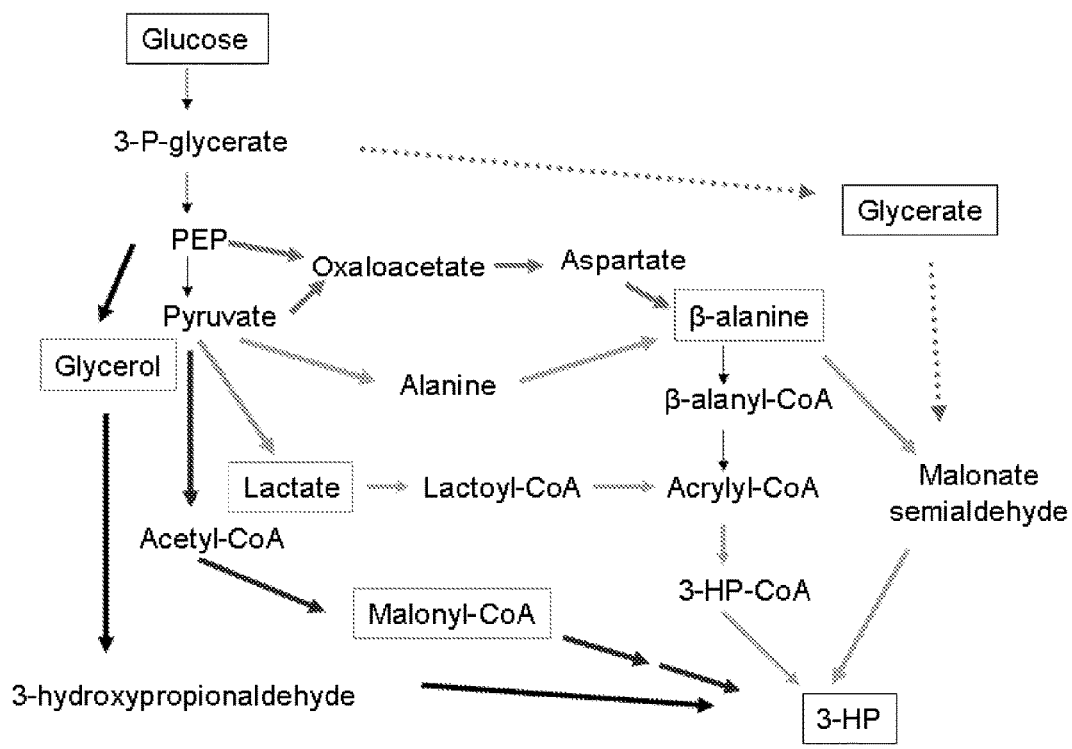
FIG. 1 shows a summary of select 3-HP pathways from glucose.

Abbreviations: 3-HPA, 3-hydroxypropionaldehyde; 3-HPDH, 3-hydroxypropionic acid dehydrogenase; AAM, alanine 2,3-aminomutase; AAT, aspartate aminotransferase; ACC, acetyl-CoA carboxylase; ADC, aspartate 1-decarboxylase; AKG, alpha-ketoglutarate; ALD, aldehyde dehydrogenase; BAAT, β-alanine aminotransferase; BCKA, branched-chain alpha-keto acid decarboxylase; bp, base pairs; CYB2, L-(+)-lactate-cytochrome c oxidoreductase; CYC, iso-2-cytochrome c; EMS, ethane methyl sulfonase; ENO, enolase; gabT, 4-aminobutyrate aminotransferase; GAPDH, glyceraldehyde-3-phosphate dehydrogenase 3; GPD, glycerol 3-phosphate dehydrogenase; GPP, glycerol 3-phosphate phosphatase; HIBADH, 3-hydroxyisobutyrate dehydrogenase; IPDA, indolepyruvate decarboxylase; KGD, alpha-ketoglutarate decarboxylase; LDH, lactate dehydrogenase; MAE, malic enzyme; MDHB, malate dehydrogenase B; OAA, oxaloacetate; PCK, phosphoenolpyruvate carboxykinase; PDC, pyruvate decarboxylase; PDH, pyruvate dehydrogenase; PEP, phosphoenolpyruvate; PGK, phosphoglycerate kinase; PPC, phosphoenolpyruvate carboxylase; PYC, pyruvate carboxylase; RKI, ribose 5-phosphate ketol-isomerase; TAL, transaldolase; TEF1, translation elongation factor-1; TEF2, translation elongation factor-2; TKL, transketolase; XDH, xylitol dehydrogenase; XR, xylose reductase; YP, yeast extract/peptone.

Active 3-HP pathway: As used herein, a host cell having an "active 3-HP pathway" produces active enzymes necessary to catalyze each reaction of a metabolic pathway in a sufficient amount to produce 3-HP from a fermentable sugar, and therefore is capable of producing 3-HP in measurable yields when cultivated under fermentation conditions in the presence of at least one fermentable sugar. A host cell having an active 3-HP pathway comprises one or more 3-HP pathway genes. A "3-HP pathway gene" as used herein refers to a gene that encodes an enzyme involved in an active 3-HP pathway.

The active enzymes necessary to catalyze each reaction in an active 3-HP pathway may result from activities of endogenous gene expression, activities of heterologous gene expression, or a combination of activities of endogenous and heterologous gene expression, as described in more detail herein.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Aspartate 1-decarboxylase (ADC): The term "aspartate decarboxylase" or "ADC" as used herein is an enzyme that catalyzes the chemical reaction of conversion of aspartate to β-alanine (e.g., EC 4.1.1.11). ADC activity may be determined, e.g., from cell-free extracts as described in the art, or as in the Examples herein. For example, ADC activity may be measured using LC/MS/MS to monitor β-alanine produced at different time intervals in a reaction mixture containing 29 µL of 100 mM ammonium acetate buffer (pH 6 or 7.6), 160 µL of 25 mM aspartate (after neutralizing with NaOH), and 1 µL of 30 mM pyridoxal-5-phosphate at 40° C., 30° C., or 25° C.

ADC genes may be derived from a bacterial source or source of the Class Insecta, Bivalvia, Branchiopoda, Gastropoda, or Leptocardii. The term "*Insect aspartate* 1-decarboxylase" or "insect ADC" is an ADC derived from an insect source (Class: "Insecta") and includes both natural and man-made variants based on a parent insect ADC.

Class Bivalvia: The term "Class Bivalvia" means herein a taxonomic class within the phylum Mollusca and includes true oysters.

Class Branchiopoda: The term "Class Branchiopoda" means herein a taxonomic class within the subphylum Crustacea and includes small aquatic crustaceans, e.g., water fleas and fairy shrimps.

Class Insecta: The term "Class Insecta" means herein a taxonomic class of within the phylum Arthropoda and include insects of the Orders Blattodea, Coleoptera, Dermaptera, Diptera, Embiidina, Ephemeroptera, Hemiptera, Hymenoptera, Lepidoptera, Mantoptera, Mecoptera, Megaloptera, Microcoryphia, Neuroptera, Notoptera, Odonata, Orthoptera, Phasmatodea, Plecoptera, Psocoptera, Raphidioptera, Siphonaptera, Strepsiptera, Thysanoptera, Trichoptera, Zoraptera, and Zygentoma.

Class Gastropoda: The term "Class Gastropoda" means herein a taxonomic class within the phylum Mollusca and includes snails and slugs of all kinds and sizes from microscopic to large.

Class Leptocardii: The term "Class Leptocardii" means herein a taxonomic class within the subphylum Cephalochordata of the phylum Chordata and includes lancelets and amphioxus.

Coding sequence: The term "coding sequence" or "coding region" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide (e.g., a codon-optimized polynucleotide), and/or a recombinant polynucleotide.

Control sequence: The term "control sequence" means a nucleic acid sequence necessary for polypeptide expression. Control sequences may be native or foreign to the polynucleotide encoding the polypeptide, and native or foreign to each other. Such control sequences include, but are not limited to, a leader sequence, polyadenylation sequence, propeptide sequence, promoter sequence, signal peptide sequence, and transcription terminator sequence. The control sequences may be provided with linkers for the purpose of introducing specific restriction sites facilitating ligation of the control sequences with the coding region of the polynucleotide encoding a polypeptide.

Disruption: The term "disruption" means that a coding region and/or control sequence of a referenced gene is partially or entirely modified (such as by deletion, insertion, and/or substitution of one or more nucleotides) resulting in the absence (inactivation) or decrease of expression, and/or the absence or decrease of enzyme activity of the encoded polypeptide. The effects of disruption can be measured using techniques known in the art such as detecting the absence or decrease of enzyme activity from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see Methods in Yeast Genetics (1997 edition), Adams, Gottschling, Kaiser, and Stems, Cold Spring Harbor Press (1998)).

Endogenous gene: The term "endogenous gene" means a gene that is native to the referenced host cell. "Endogenous gene expression" means expression of an endogenous gene.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences, wherein the control sequences provide for expression of the polynucleotide encoding the polypeptide. At a minimum, the expression vector comprises a promoter sequence, and transcriptional and translational stop signal sequences.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as 3-HP. In some instances, the fermentation medium is derived from a natural source, such as sugar cane, starch, or cellulose, and may be the result of pretreating the source by enzymatic hydrolysis (saccharification).

Heterologous polynucleotide: The term "heterologous polynucleotide" is defined herein as a polynucleotide that is not native to the host cell; a native polynucleotide in which structural modifications have been made to the coding region; a native polynucleotide whose expression is quantitatively altered as a result of a manipulation of the DNA by recombinant DNA techniques, e.g., a different (foreign) promoter; or a native polynucleotide in a host cell having one or more extra copies of the polynucleotide to quantitatively alter expression. A "heterologous gene" is a gene comprising a heterologous polynucleotide.

High stringency conditions: The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 65° C.

3-HP: The term "3-HP" includes salt and acid forms of "3-hydroxypropionic acid".

Host cell: The term "host cell" means any cell type that is susceptible to transformation, transfection, transduction, and the like with a nucleic acid construct or expression vector. The term "host cell" encompasses any progeny of a parent cell that is not identical to the parent cell due to mutations that occur during replication. The term "recombinant yeast cell" is defined herein as a non-naturally occurring yeast host cell comprising one or more (e.g., two, several) heterologous polynucleotides.

Low stringency conditions: The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 50° C.

Medium stringency conditions: The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 55° C.

Medium-high stringency conditions: The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 60° C.

Nucleic acid construct: The term "nucleic acid construct" means a polynucleotide comprising one or more (e.g., two, several) control sequences. The polynucleotide may be single-stranded or double-stranded, and may be isolated from a naturally occurring gene, modified to contain segments of nucleic acids in a manner that would not otherwise exist in nature, or is synthetic.

Operably linked: The term "operably linked" means a configuration in which a control sequence is placed at an appropriate position relative to the coding sequence of a polynucleotide such that the control sequence directs expression of the coding sequence.

Sequence Identity: The relatedness between two amino acid sequences or between two nucleotide sequences is described by the parameter "sequence identity".

For purposes described herein, the degree of sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. The optional parameters used are a gap open penalty of 10, a gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

$$(\text{Identical Residues} \times 100)/(\text{Length of the Referenced Sequence} - \text{Total Number of Gaps in Alignment})$$

For purposes described herein, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are a gap open penalty of 10, a gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

$$(\text{Identical Deoxyribonucleotides} \times 100)/(\text{Length of Referenced Sequence} - \text{Total Number of Gaps in Alignment})$$

Very high stringency conditions: The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 70° C.

Very low stringency conditions: The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 45° C.

Volumetric productivity: The term "volumetric productivity" refers to the amount of referenced product produced (e.g., the amount of 3-HP produced) per volume of the system used (e.g., the total volume of medium and contents therein) per unit of time.

Reference to "about" a value or parameter herein includes aspects that are directed to that value or parameter per se. For example, description referring to "about X" includes the aspect "X". When used in combination with measured values, "about" includes a range that encompasses at least the uncertainty associated with the method of measuring the particular value, and can include a range of plus or minus two standard deviations around the stated value.

As used herein and in the appended claims, the singular forms "a," "or," and "the" include plural referents unless the context clearly dictates otherwise. It is understood that the aspects described herein include "consisting" and/or "consisting essentially of" aspects.

Unless defined otherwise or clearly indicated by context, all technical and scientific terms used herein have the same meaning as commonly understood by one of ordinary skill in the art.

DETAILED DESCRIPTION

Described herein, inter alia, are recombinant yeast cells that comprise a heterologous polynucleotide encoding an aspartate 1-decarboxylase (ADC) of the Class Insecta.

The aspartate 1-decarboxylase (ADC) can be any insect ADC of the Class Insecta that is suitable for the host cells and their methods of use described herein, such as a naturally occurring ADC or a variant thereof that retains ADC activity. Unlike bacterial ADCs that self-cleave to generate a pyruvoyl moiety for catalysis, insect ADCs use pyridoxal-5'-phosphate (PLP) as a cofactor and share considerably higher sequence identity to glutamate decarboxylases (GDCs) compared to bacterial ADCs (see Liu et al., 2012, *Insect Biochem. Mol. Bio.* 42: 396-403).

With the exception of aspartate 1-decarboxylase (ADC) activity, yeast cells have been shown to comprise endogenous activity for all enzymes necessary in a 3-HP pathway proceeding through PEP or pyruvate, OAA, aspartate, β-alanine, and malonate semialdehyde intermediates (see FIG. 1). Heterologous ADCs from bacterial sources have been expressed in yeast cells to complete the 3-HP pathway and produce 3-HP (see WO 2012/074818).

The Applicant has surprisingly found that expression of an insect aspartate 1-decarboxylase (ADC), such as the *Aedes aegypti* ADC of SEQ ID NO: 162, the *Drosophila melanogaster* ADC of SEQ ID NO: 169, the *Danaus plexippus* ADC of SEQ ID NO: 170, or the *Apis mellifera* ADC of SEQ ID NO: 181, in a recombinant yeast host cell significantly enhances the production of metabolic 3-HP compared to other heterologous ADC enzymes.

Accordingly, in one aspect is a recombinant yeast cell, wherein the cell comprises a heterologous polynucleotide encoding an aspartate 1-decarboxylase (ADC) of the Class Insecta, and wherein the cell is capable of producing 3-HP. In another aspect is a recombinant yeast cell, wherein the cell comprises a heterologous polynucleotide encoding an aspartate 1-decarboxylase (ADC) of the Class Bivalvia, Branchiopoda, Gastropoda, or Leptocardii, and wherein the cell is capable of producing 3-HP.

In another aspect, the ADC is pyridoxal-5'-phosphate (PLP) dependent. In another aspect, the ADC is present in the cytosol of the host cells.

In other aspects, the recombinant yeast cells comprising a heterologous polynucleotide encoding an ADC of the Class Insecta, Bivalvia, Branchiopoda, Gastropoda, or Leptocardii have an increased level of ADC activity compared to the host cells without the heterologous polynucleotide encoding the ADC, when cultivated under the same conditions. In other aspects, the yeast cells have an increased level of ADC activity of at least 5%, e.g., at least 10%, at least 15%, at least 20%, at least 25%, at least 50%, at least 100%, at least 150%, at least 200%, at least 300%, or at 500% compared to the host cells without the heterologous polynucleotide encoding the ADC of the Class Insecta, Bivalvia, Branchiopoda, Gastropoda, or Leptocardii, when cultivated under the same conditions.

Potential ADCs that may be used with the host cells and methods of use described herein, include, but are not limited to, the polypeptides of the Class Insecta as described in Table 1. Other ADCs from the Classes Bivalvia, Branchiopoda, Gastropoda, and Leptocardii are described in Table 2.

TABLE 1

| Sequence accession number | Order | Species | | SEQ ID NO |
|---|---|---|---|---|
| SWISSPROT:Q171S0 | Diptera | *Aedes aegypti* | Yellow fever mosquito | 162 |
| SWISSPROT:B0WRQ9 | Diptera | *Culex quinquefasciatus* | Southern house mosquito | 163 |
| SWISSPROT:Q7PWN7 | Diptera | *Anopheles gambiae* | African malaria mosquito | 164 |
| SWISSPROT:A7U8C7 | Coleoptera | *Tribolium castaneum* | Red flour beetle | 165 |
| AH00280 | Coleoptera | *Attagenus smirnovi* | Brown carpet beetle | 166 |
| SWISSPROT:J9KAH8 | Hemiptera | *Acyrthosiphon pisum* | Pea aphid | 167 |

TABLE 1-continued

| Sequence accession number | Order | Species | | SEQ ID NO |
|---|---|---|---|---|
| SWISSPROT:B4HXA1 | Diptera | Drosophila sechellia | Fruit fly | 168 |
| SWISSPROT:Q24062 | Diptera | Drosophila melanogaster | Fruit fly | 169 |
| SWISSPROT:G6DJC4 | Lepidoptera | Danaus plexippus | Monarch butterfly | 170 |
| SWISSPROT:B4P3Q4 | Diptera | Drosophila yakuba | Fruit fly | 171 |
| SWISSPROT:B3NAD2 | Diptera | Drosophila erecta | Fruit fly | 172 |
| SWISSPROT:D4AH66 | Lepidoptera | Papilio xuthus | Asian Swallowtail | 173 |
| SWISSPROT:B4GX04 | Diptera | Drosophila persimilis | Fruit fly | 174 |
| SWISSPROT:H9JRC8 | Lepidoptera | Bombyx mori | Silk moth | 175 |
| SWISSPROT:B3MN27 | Diptera | Drosophila ananassae | Fruit fly | 176 |
| SWISSPROT:B4KIX9 | Diptera | Drosophila mojavensis | Fruit fly | 177 |
| SWISSPROT:B4JCX3 | Diptera | Drosophila grimshawi | Fruit fly | 178 |
| SWISSPROT:G4XH89 | Lepidoptera | Biston betularia | Pepper-and-salt moth | 179 |
| SWISSPROT:B4N0X5 | Diptera | Drosophila willistoni | Fruit fly | 180 |
| SWISSPROT:H9KIF0 | Hymenoptera | Apis mellifera | Honeybee | 181 |
| SWISSPROT:B4M8L3 | Diptera | Drosophila virilis | Fruit fly | 182 |
| SWISSPROT:K7IY18 | Hymenoptera | Nasonia vitripennis | Parasitic wasp | 183 |
| SWISSPROT:G8FGR7 | Lepidoptera | Bicyclus anynana | Squinting bush brown | 184 |
| SWISSPROT:E2B481 | Hymenoptera | Harpegnathos saltator | Jerdon's jumping ant | 185 |
| SWISSPROT:F4WHT2 | Hymenoptera | Acromyrmex echinatior | Panamanian leafcutter ant | 186 |
| SWISSPROT:E1ZV07 | Hymenoptera | Camponotus floridanus | Florida carpenter ant | 187 |
| SWISSPROT:E0VFI7 | Phthiraptera | Pediculus humanus | Head louse; Body louse | 188 |
| SWISSPROT:H9I8M1 | Hymenoptera | Atta cephalotes | Leafcutter ant | 189 |
| EFP4LJZV | Coleoptera | Brassicogethes aeneus O123UD (Meligethes aeneus) | Pollen beetle | 190 |
| SWISSPROT:E9J4Y6 | Hymenoptera | Solenopsis invicta | Red imported fire ant | 191 |

TABLE 2

| Sequence accession number | Class | Species | | SEQ ID NO |
|---|---|---|---|---|
| SWISSPROT:E9G2R8 | Branchiopoda | Daphnia pulex | Water flea | 192 |
| SWISSPROT:V4C2P0 | Gastropoda | Lottia gigantea (Sea snail) | Owl limpet | 193 |
| SWISSPROT:B6LUQ5 | Leptocardii | Branchiostoma floridae | Florida lancelet; Amphioxus | 194 |
| SWISSPROT:K1QRN2 | Bivalvia | Crassostrea gigas | Pacific oyster | 195 |

The ADC may be obtained from an insect of an Order selected from the group consisting of Blattodea, Coleoptera, Dermaptera, Diptera, Embiidina, Ephemeroptera, Hemiptera, Hymenoptera, Lepidoptera, Mantoptera, Mecoptera, Megaloptera, Microcoryphia, Neuroptera, Notoptera, Odonata, Orthoptera, Phasmatodea, Plecoptera, Psocoptera, Raphidioptera, Siphonaptera, Strepsiptera, Thysanoptera, Trichoptera, Zoraptera, and Zygentoma.

In one aspect, the ADC is obtained from an organism (insect) of the Class Insecta. In another aspect, the ADC is obtained from an insect of the Order Blattodea (e.g., Cockroaches and Termites). In another aspect, the ADC is obtained from an insect of the Order Coleoptera (e.g., Beetles). In another aspect, the ADC is obtained from an insect of the Order Dermaptera (e.g., Earwigs). In another aspect, the ADC is obtained from an insect of the Order Diptera (e.g., Flies and Mosquitoes). In another aspect, the ADC is obtained from an insect of the Order Embiidina (e.g., Webspinners). In another aspect, the ADC is obtained from an insect of the Order Ephemeroptera (e.g., Mayflies). In another aspect, the ADC is obtained from an insect of the Order Hemiptera (e.g., True Bugs, Cicadas, Hoppers, and Aphids). In another aspect, the ADC is obtained from an insect of the Order Hymenoptera (e.g., Ants, Bees, Wasps, and Sawflies). In another aspect, the ADC is obtained from an insect of the Order Lepidoptera (e.g., Butterflies and Moths). In another aspect, the ADC is obtained from an insect of the Order Mantoptera (e.g., Mantids). In another aspect, the ADC is obtained from an insect of the Order Mecoptera (e.g., Scorpionflies and Hangingflies). In another aspect, the ADC is obtained from an insect of the Order Megaloptera (e.g., Alderflies, Dobsonflies, and Fishflies). In another aspect, the ADC is obtained from an insect of the Order Microcoryphia (e.g., Bristletails). In another aspect, the ADC is obtained from an insect of the Order Neuroptera (e.g., Antlions and Lacewings). In another aspect, the ADC is obtained from an insect of the Order Notoptera (e.g., Rock Crawlers). In another aspect, the ADC is obtained from an insect of the Order Odonata (e.g., Dragonflies and Damselflies). In another aspect, the ADC is obtained from an insect of the Order Orthoptera (e.g., Grasshoppers, Crickets, and Katydids). In another aspect, the ADC is obtained from an insect of the Order Phasmatodea (e.g., Walkingsticks). In another aspect, the ADC is obtained from an insect of the Order Plecoptera (e.g., Stoneflies and Chewing Lice). In another aspect, the ADC is obtained from an insect of the Order Psocoptera (e.g., Barklice, Booklice, and Parasitic Lice). In another aspect, the ADC is obtained from an insect of the Order Raphidioptera (e.g., Snakeflies). In another aspect, the ADC is obtained from an insect of the Order Siphonaptera (e.g., Fleas). In another aspect, the ADC is obtained from an insect of the Order Strepsiptera (e.g., Twisted-winged Insects). In another aspect, the ADC is obtained from an insect of the Order Thysanoptera (e.g., *Thrips*). In another aspect, the ADC is obtained from an insect of the Order Trichoptera (e.g., Caddisflies). In another aspect, the ADC is obtained from an insect of the Order Zoraptera (e.g., Zorapterans). In another aspect, the ADC is obtained from an insect of the Order Zygentoma (e.g., Silverfish).

Additional polynucleotides encoding suitable insect ADCs may be obtained from any suitable insect genus or species, including those readily available within the UniProtKB database.

In another aspect, the insect ADC is an *Aedes* ADC, such as the *Aedes aegypti* ADC of SEQ ID NO: 162. In another aspect, the insect ADC is a *Culex* ADC, such as the *Culex quinquefasciatus* ADC of SEQ ID NO: 163. In another aspect, the insect ADC is an *Anopheles* ADC, such as the *Anopheles gambiae* ADC of SEQ ID NO: 164. In another aspect, the insect ADC is a *Tribolium* ADC, such as the *Tribolium castaneum* ADC of SEQ ID NO: 165. In another aspect, the insect ADC is an *Attagenus* ADC, such as the *Attagenus smirnovi* ADC of SEQ ID NO: 166. In another aspect, the insect ADC is an *Acyrthosiphon ADC, such as the Acyrthosiphon pisum* ADC of SEQ ID NO: 167. In another aspect, the insect ADC is a *Drosophila* ADC, such as the *Drosophila sechellia* ADC of SEQ ID NO: 168, the *Drosophila melanogaster* ADC of SEQ ID NO: 169, the *Drosophila yakuba* ADC of SEQ ID NO: 171, the *Drosophila erecta* ADC of SEQ ID NO: 172, the *Drosophila persimilis* ADC of SEQ ID NO: 174, the *Drosophila ananassae* ADC of SEQ ID NO: 176, the *Drosophila mojavensis* ADC of SEQ ID NO: 177, the *Drosophila grimshawi* ADC of SEQ ID NO: 178, the *Drosophila willistoni* ADC of SEQ ID NO: 180, or the *Drosophila virilis* ADC of SEQ ID NO: 182. In another aspect, the insect ADC is a *Danaus* ADC, such as the *Danaus plexippus* ADC of SEQ ID NO: 170. In another aspect, the insect ADC is a *Papilio* ADC, such as the *Papilio xuthus* ADC of SEQ ID NO: 173. In another aspect, the insect ADC is a *Bombyx* ADC, such as the *Bombyx mori* ADC of SEQ ID NO: 175. In another aspect, the insect ADC is a *Biston* ADC, such as the *Biston betularia* ADC of SEQ ID NO: 179. In another aspect, the insect ADC is an *Apis* ADC, such as the *Apis mellifera* ADC of SEQ ID NO: 181.

In another aspect, the insect ADC is a *Nasonia* ADC, such as the *Nasonia vitripennis* ADC of SEQ ID NO: 183. In another aspect, the insect ADC is a *Bicyclus* ADC, such as the *Bicyclus anynana* ADC of SEQ ID NO: 184. In another aspect, the insect ADC is a *Harpegnathos* ADC, such as the *Harpegnathos saltator* ADC of SEQ ID NO: 185. In another aspect, the insect ADC is an *Acromyrmex echinatior* ADC, such as the *Acromyrmex echinatior* ADC of SEQ ID NO: 186. In another aspect, the insect ADC is a *Camponotus* ADC, such as the *Camponotus floridanus* ADC of SEQ ID NO: 187. In another aspect, the insect ADC is a *Pediculus* ADC, such as the *Pediculus humanus* ADC of SEQ ID NO: 188. In another aspect, the insect ADC is an *Atta* ADC, such as the *Atta cephalotes* ADC of SEQ ID NO: 189. In another aspect, the insect ADC is a *Meligethes* ADC, such as the *Meligethes aeneus* ADC of SEQ ID NO: 190. In another aspect, the insect ADC is a *Solenopsis* ADC, such as the *Solenopsis invicta* ADC of SEQ ID NO: 191.

The ADC may also be obtained from an organism of a Class selected from the group consisting of Bivalvia, Branchiopoda, Gastropoda, and Leptocardii.

In another aspect, the ADC is a *Daphnia* ADC, such as the *Daphnia pulex* ADC of SEQ ID NO: 192. In another aspect, the ADC is a *Lottia* ADC, such as the *Lottia gigantea* ADC of SEQ ID NO: 193. In another aspect, the ADC is a *Branchiostoma* ADC, such as the *Branchiostoma floridae* ADC of SEQ ID NO: 194. In another aspect, the ADC is a *Crassostrea* ADC, such as the *Crassostrea gigas* ADC of SEQ ID NO: 195.

The ADC coding sequences, or subsequences thereof, as well as the corresponding amino acid sequences, or fragments thereof, described herein, may be used to design nucleic acid probes to identify and clone an ADC from different genera or species according to methods well known in the art. In particular, such probes can be used for hybridization with the genomic or cDNA of the genus or species of interest, following standard Southern blotting procedures, in order to identify and isolate the corresponding gene therein. Such probes can be considerably shorter than the entire sequence, e.g., at least 14 nucleotides, at least 25 nucleotides, at least 35 nucleotides, at least 70 nucleotides in lengths. The probes may be longer, e.g., at least 100 nucleotides, at least 200 nucleotides, at least 300 nucleotides, at least 400 nucleotides, at least 500 nucleotides in lengths. Even longer probes may be used, e.g., at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}$P, $^{3}$H, $^{35}$S, biotin, or avidin).

A genomic DNA or cDNA library prepared from such other genera or species may be screened for DNA that hybridizes with the probes described above and encodes a polypeptide having ADC activity. Genomic or other DNA from such other genera or species may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that is homologous with the ADC coding sequences, or a subsequence thereof, the carrier material may be used in a Southern blot.

For purposes of the probes described above, hybridization indicates that the polynucleotide hybridizes to a labeled nucleic acid probe, or the full-length complementary strand thereof, or a subsequence of the foregoing, under very low to very high stringency conditions. Molecules to which the nucleic acid probe hybridizes under these conditions can be detected using, for example, X-ray film. For long probes of at least 100 nucleotides in length, very low to very high stringency and washing conditions are defined as described herein. For short probes of about 15 nucleotides to about 70 nucleotides in length, stringency and washing conditions are defined as prehybridization and hybridization at about 5° C. to about 10° C. below the calculated $T_m$ using the calculation according to Bolton and McCarthy (1962, *Proc. Natl. Acad. Sci. USA* 48:1390) in 0.9 M NaCl, 0.09 M Tris-HCl pH 7.6, 6 mM EDTA, 0.5% NP-40, 1×Denhardt's solution, 1 mM sodium pyrophosphate, 1 mM sodium monobasic phosphate, 0.1 mM ATP, and 0.2 mg of yeast RNA per ml following standard Southern blotting procedures for 12 to 24 hours optimally. The carrier material is finally washed once in 6×SCC plus 0.1% SDS for 15 minutes and twice each for 15 minutes using 6×SSC at 5° C. to 10° C. below the calculated $T_m$.

Insect-like ADCs may also be identified and obtained from other sources including microorganisms isolated from nature (e.g., soil, composts, water, silage, etc.) or DNA samples obtained directly from natural materials (e.g., soil, composts, water, silage, etc.) using the above-mentioned probes. Techniques for isolating microorganisms and DNA directly from natural habitats are well known in the art. The polynucleotide encoding an ADC may then be derived by similarly screening a genomic or cDNA library of another microorganism or mixed DNA sample. It is understood herein that the term "insect-like ADC" is encompassed by the term "insect ADC".

Once a polynucleotide encoding an ADC has been detected with a suitable probe as described herein, the sequence may be isolated or cloned by utilizing techniques that are known to those of ordinary skill in the art (see, e.g., Sambrook et al., 1989, *Molecular Cloning, A Laboratory Manual*, 2d edition, Cold Spring Harbor, New York). Techniques used to isolate or clone polynucleotides encoding ADCs include isolation from genomic DNA, preparation from cDNA, or a combination thereof. The cloning of the polynucleotides from such genomic DNA can be effected, e.g., by using the well-known polymerase chain reaction (PCR) or antibody screening of expression libraries to detect cloned DNA fragments with shares structural features. See, e.g., Innis et al., 1990, *PCR: A Guide to Methods and Application*, Academic Press, New York. Other nucleic acid amplification procedures such as ligase chain reaction (LCR), ligated activated transcription (LAT) and nucleotide sequence-based amplification (NASBA) may be used.

In one aspect, the heterologous polynucleotide: (a) encodes an insect ADC having at least 60% sequence identity to any of SEQ ID NOs: 162-191; (b) comprises a coding sequence that hybridizes under at least low stringency conditions with the full-length complementary strand of a coding sequence for any of SEQ ID NOs: 162-191; or (c) comprises a coding sequence having at least 60% sequence identity to a coding sequence for any of SEQ ID NOs: 162-191.

In another aspect, the heterologous polynucleotide: (a) encodes an ADC having at least 60% sequence identity to any of SEQ ID NOs: 192-195; (b) comprises a coding sequence that hybridizes under at least low stringency conditions with the full-length complementary strand of a coding sequence for any of SEQ ID NOs: 192-195; or (c) comprises a coding sequence having at least 60% sequence identity to a coding sequence for any of SEQ ID NOs: 192-195.

As can be appreciated by one of skill in the art, in some instances the heterologous polynucleotides may qualify under more than one of the respective selections (a), (b) and (c) noted above.

In another aspect, the heterologous polynucleotide encodes an insect ADC having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any of SEQ ID NOs: 162-191. In another aspect, the heterologous polynucleotide encodes an ADC having a sequence that differs by no more than ten amino acids, e.g., by no more than five amino acids, by no more than four amino acids, by no more than three amino acids, by no more than two amino acids, or by one amino acid from to any of SEQ ID NOs: 162-191. In another aspect, the heterologous polynucleotide encodes an insect ADC comprising or consisting of the amino acid sequence to any of SEQ ID NOs: 162-191, an allelic variant thereof, or a fragment of the foregoing having ADC activity.

In another aspect, the heterologous polynucleotide encodes an ADC having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any of SEQ ID NOs: 192-195. In another aspect, the heterologous polynucleotide encodes an ADC having a sequence that differs by no more than ten amino acids, e.g., by no more than five amino acids, by no more than four amino acids, by no more than three amino acids, by no more than two amino acids, or by one amino acid from to any of SEQ ID NOs: 192-195. In another aspect, the heterologous polynucleotide encodes an ADC comprising or consisting of the amino acid sequence to any of SEQ ID NOs: 192-195, an allelic variant thereof, or a fragment of the foregoing having ADC activity.

In another aspect, the ADC has an amino acid substitution, deletion, and/or insertion of one or more (e.g., two, several) amino acids of any of the ADCs described above. In some aspects, the total number of amino acid substitutions, deletions and/or insertions is not more than 10, e.g., not more than 9, 8, 7, 6, 5, 4, 3, 2, or 1.

The amino acid changes are generally of a minor nature, that is conservative amino acid substitutions or insertions that do not significantly affect the folding and/or activity of the protein; small deletions, typically of one to about 30 amino acids; small amino-terminal or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, *In, The Proteins*, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the ADC, alter the substrate specificity, change the pH optimum, and the like.

Essential amino acids can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for ADC activity to identify amino acid residues that are critical to the activity of the molecule. See also, Hilton et al., 1996, *J. Biol. Chem.* 271: 4699-4708. The active site of the ADC or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identities of essential amino acids can also be inferred from analysis of identities with other ADCs that are related to the referenced ADC.

Figure 22:
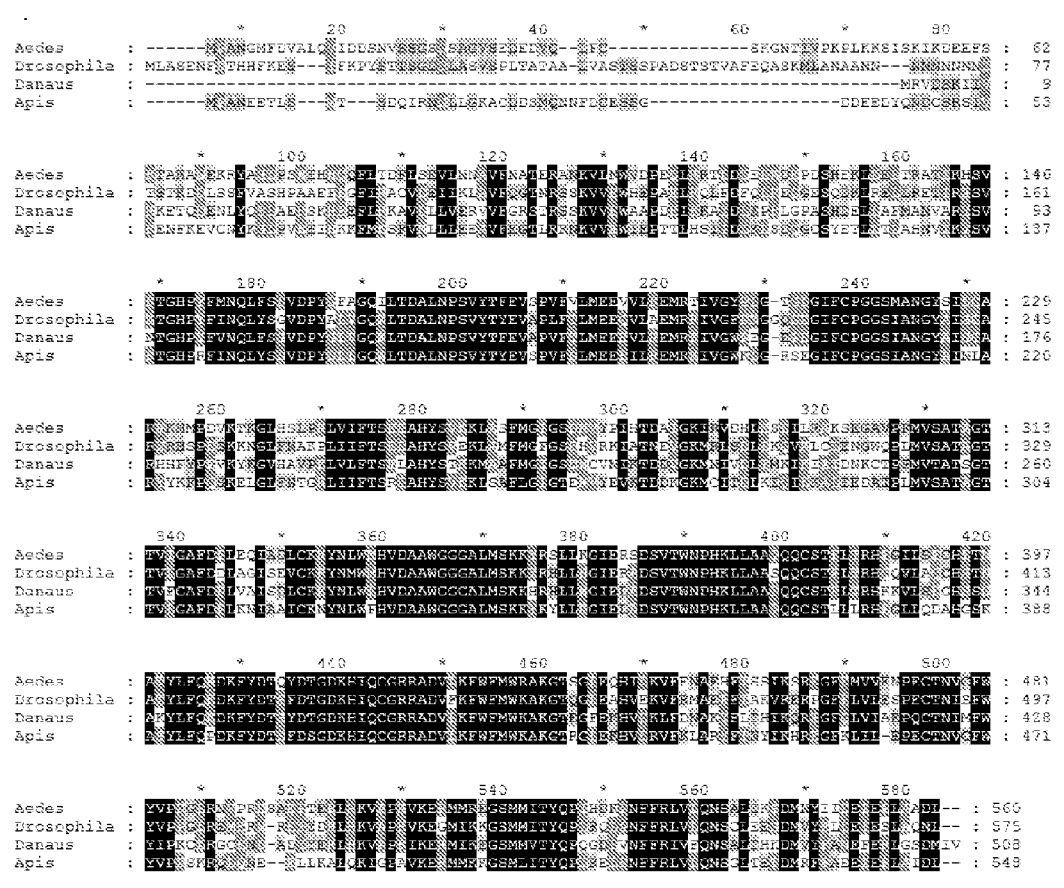

Additional guidance on the structure-activity relationship of the insect ADCs herein can be determined using multiple sequence alignment (MSA) techniques well-known in the art. FIG. 22, for example, shows a multiple sequence alignment of the insect ADCs of SEQ ID NOs: 162 (*Aedes aegypti*), 169 (*Drosophila melanogaster*), 170 (*Danaus plexippus*), and 181 (*Apis mellifera*). Based on the teachings herein, the skilled artisan could make similar alignments with any number of insect ADCs described herein or known in the art. Such alignments aid the skilled artisan to determine potentially relevant domains (e.g., binding domains or catalytic domains), as well as which amino acid residues are conserved and not conserved among the different insect ADC sequences. It is appreciated in the art that changing an amino acid that is conserved at a particular position between the disclosed ADCs will more likely result in a change in biological activity (Bowie et al., 1990, *Science* 247: 1306-1310: "Residues that are directly involved in protein functions such as binding or catalysis will certainly be among the most conserved"). In contrast, substituting an amino acid that is not highly conserved between the ADCs will not likely or significantly alter the biological activity.

Liu et al., 2012, *Insect Biochem. Mol. Bio.* 42: 396-403, have provided particularly relevant guidance on the insect ADC structure-activity relationship using the *Aedes aegypti* ADC of SEQ ID NO: 162 based on homology modeling, substrate docking, and site-directed mutagenesis. This work identified key residues for activity and substrate specificity (such as the role of residue Q377 in aspartate selectivity of insect ADCs). Accordingly, in one aspect, the heterologous polynucleotide encodes an ADC having a glutamine at the residue corresponding to position 377 of SEQ ID NO: 162.

Even more guidance on the structure-activity relationship is taught by Agnello et al., 2013, *ACS Chem. Biol.* 8: 2264-2271, which shows that a recognition motif of $F_1aa_{19}S_2aaY_3$ or $Y_1aa_{19}S_2aaY_3$ is a "structural fingerprint" for these proteins having aspartate decarboxylase activity, wherein $F_1$ is phenylalanine, $Y_1$ is tyrosine, $aa_{19}$ is an intervening sequence of nineteen amino acids, $S_2$ is serine, aa is a single amino acid, and $Y_3$ is tyrosine. These structural fingerprints can be found in ADCs of the Classes Insecta, Bivalvia, Branchiopoda, Gastropoda, and Leptocardii, such as the ADCs of SEQ ID NOs: 162-195, Tables 1 and 2, and FIG. 2. Thus, in some embodiments, the heterologous polynucleotide encodes an ADC having the motif $F_1aa_{19}S_2aaY_3$ or motif $Y_1aa_{19}S_2aaY_3$.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active ADCs can be recovered from the host cells and rapidly sequenced using standard methods in the art. These methods allow the rapid determination of the importance of individual amino acid residues in a polypeptide.

In some aspects, the ADC has at least 20%, e.g., at least 40%, at least 50%, at least 60%, at least 65%, at least 70%, at least 75%, at least 80%, at least 90%, at least 95%, at least 96%, at least 97%, at least 98%, at least 99%, or 100% of the ADC activity of any polypeptide described herein (e.g., any of SEQ ID NOs: 162-195) under the same conditions.

The ADC may be a fused polypeptide or cleavable fusion polypeptide in which another polypeptide is fused at the N-terminus or the C-terminus of the ADC. A fused polypeptide may be produced by fusing a polynucleotide encoding another polypeptide to a polynucleotide encoding the ADC. Techniques for producing fusion polypeptides are known in the art, and include ligating the coding sequences encoding the polypeptides so that they are in frame and that expression of the fused polypeptide is under control of the same promoter(s) and terminator. Fusion proteins may also be constructed using intein technology in which fusions are created post-translationally (Cooper et al., 1993, *EMBO J.* 12: 2575-2583; Dawson et al., 1994, *Science* 266: 776-779).

In another aspect, the heterologous polynucleotide comprises a coding sequence that hybridizes under at least low stringency conditions, e.g., medium stringency conditions, medium-high stringency conditions, high stringency conditions, or very high stringency conditions with the full-length complementary strand of a coding sequence for any of the polypeptides of SEQ ID NOs: 162-195; such as any of the coding sequences shown in SEQ ID NOs: 157-161, 212-215, 219-222, 223-226, and 232-233 (see, e.g., Sambrook et al., 1989, supra). In another aspect, the heterologous polynucleotide comprises a coding sequence having at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity to a coding sequence for any of the polypeptides of SEQ ID NOs: 162-195; such as any of the coding sequences shown in SEQ ID NOs: 157-161, 212-215, 219-222, 223-226, and 232-233.

In another aspect, the heterologous polynucleotide encoding the ADC comprises a coding sequence for any of the polypeptides of SEQ ID NOs: 162-195; such as any of the coding sequences shown in SEQ ID NOs: 157-161, 212-215, 219-222, 223-226, and 232-233. In another aspect, the heterologous polynucleotide encoding the ADC comprises a subsequence of the coding sequence for any of the polypeptides described herein, wherein the subsequence encodes a polypeptide having ADC activity. In an embodiment, the number of nucleotide residues in the coding subsequence is at least 75%, e.g., at least 80%, 85%, 90%, or 95% of the number of nucleotides in the referenced coding sequence.

In another aspect, the heterologous polynucleotide encodes a fragment of any of the polypeptides of SEQ ID NOs: 162-195, wherein the fragment has ADC activity. In an embodiment, the number of amino acid residues in the fragment is at least 75%, e.g., at least 80%, 85%, 90%, or 95% of the number of amino acid residues in the referenced sequence.

Unless specified otherwise, the referenced coding sequence of any related aspect described herein can be the native coding sequence (e.g., a sequence readily determined by the skilled artisan using available sequence databases) or a degenerate sequence, such as a codon-optimized coding sequence designed for a particular host cell. For example, the coding sequence for the *Aedes aegypti* ADC of SEQ ID NO: 162 can be the native *Aedes aegypti* ADC coding sequence of SEQ ID NO: 157, or a codon-optimized version, such as any of the coding sequences shown in SEQ ID NOs: 158-161. Likewise, the coding sequence for the *Drosophila melanogaster* ADC of SEQ ID NO: 169 can be the native *Drosophila melanogaster* ADC coding sequence, or a codon-optimized version, such as any of the coding sequences shown in SEQ ID NOs: 223-226. Likewise, the coding sequence for the *Danaus plexippus* ADC of SEQ ID NO: 170 can be the native *Danaus plexippus* ADC coding sequence, or a codon-optimized version, such as any of the coding sequences shown in SEQ ID NOs: 212-215. Likewise, the coding sequence for the *Apis mellifera* ADC of SEQ ID NO: 181 can be the native *Apis mellifera* ADC coding sequence, or a codon-optimized version, such as any of the coding sequences shown in SEQ ID NOs: 219-222.

Figure 2:
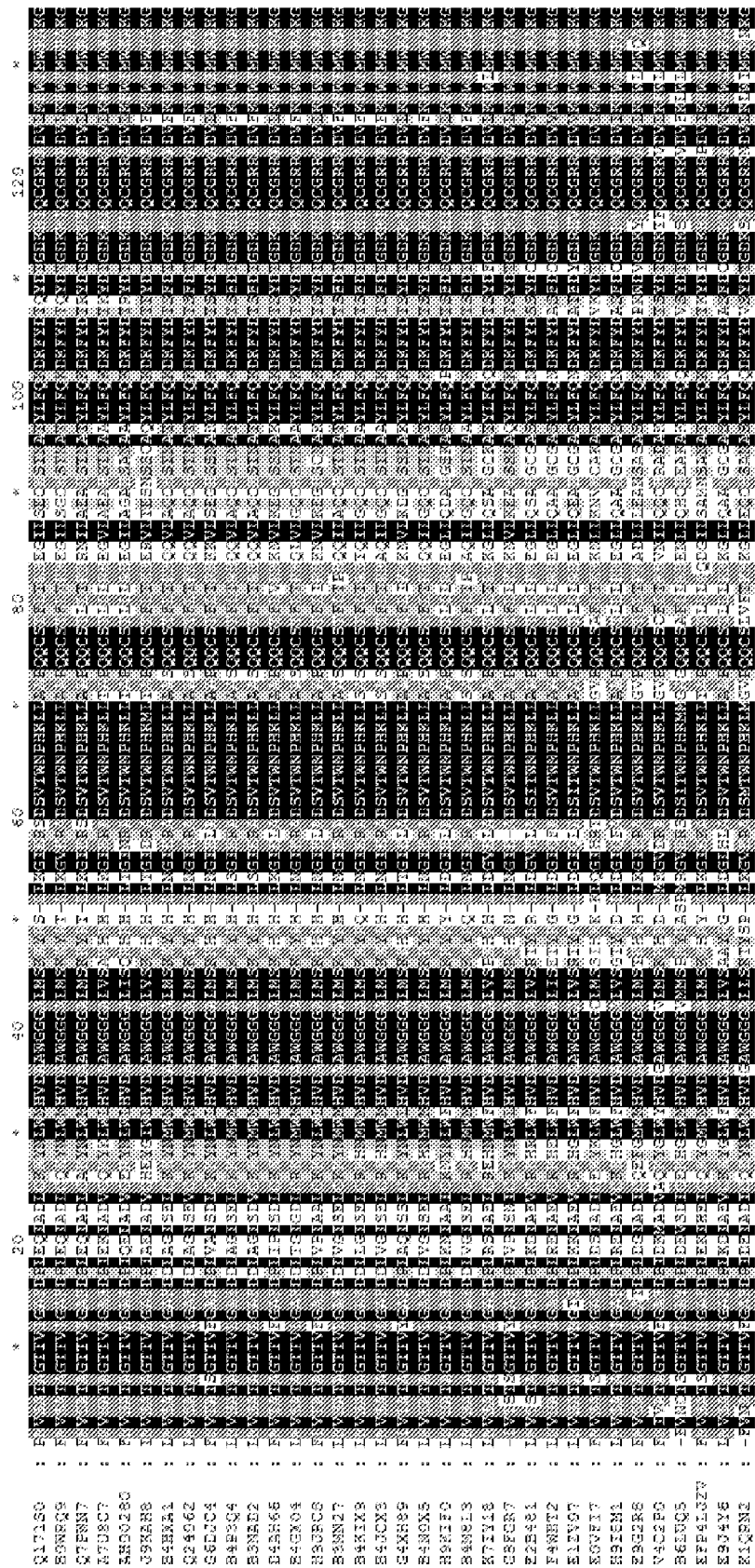
FIG. 2 shows a multiple sequence alignment for a highly homologous region of SEQ ID NOs: 162-195.

As described supra, Liu et al., 2012, supra, demonstrate that a glutamine residue corresponding to position 377 of SEQ ID NO: 162 plays a primary role in aspartate selectivity in ADCs from both mosquito and *Drosophila*. A search of the 100 closest homologs to the *Aedes aegypti* ADC of SEQ ID NO: 162 containing the conserved glutamine residue at position 377 resulted in the 30 insect sequences described in Table 1 and 4 non-insect sequences described in Table 2. A multiple sequence alignment of these 34 sequences provided a highly homologous region between amino acids 382 and 516, as shown in FIG. 2. For example, a homology matrix is shown below in Table 3 based on the region corresponding to amino acids 382 to 516 of SEQ ID NO: 162 for several insect ADCs shown above.

at least 85%, 90%, 95%, 97%, 98%, 99%, or 100% sequence identity to amino acids 382-516 of SEQ ID NO: 162. In another aspect, the heterologous polynucleotide encodes an ADC, e.g., insect ADC, comprising a glutamine at a position corresponding to position 377 of the amino acid sequence of SEQ ID NO: 162 and a partial amino acid sequence that differs by no more than ten amino acids, e.g., by no more than five amino acids, by no more than four amino acids, by no more than three amino acids, by no more than two amino acids, or by one amino acid from amino acids 382-516 of SEQ ID NO: 162.

In another aspect, the heterologous polynucleotide encodes an ADC, e.g., insect ADC, comprising a glutamine at a position corresponding to position 377 of the amino acid sequence of SEQ ID NO: 162, and a partial amino acid sequence comprising the amino acid sequence of amino acids 382-516 of SEQ ID NO: 162. In another aspect, the partial amino acid sequence has an amino acid substitution, deletion, and/or insertion of one or more (e.g., two, several) amino acids in the sequence of amino acids 382-516 of SEQ ID NO: 162. In some aspects, the total number of amino acid substitutions, deletions and/or insertions is not more than 10, e.g., not more than 9, 8, 7, 6, 5, 4, 3, 2, or 1.

Active 3-HP Pathways

The yeast cells described herein may have an active 3-HP pathway and/or heterologous polynucleotide(s) containing one or more (e.g., two, several) 3-HP pathway genes. As described herein, yeast cells have been shown to produce 3-HP from heterologous gene expression of an ADC (such as an insect ADC of the present invention) together with endogenous gene expression of the remaining genes of the 3-HP pathway. In certain embodiments, the yeast cells further comprise heterologous gene expression of one or more 3-HP pathway genes from the pathway using the ADC and/or another 3-HP pathway. For example, in some embodiments, the yeast cells comprise a heterologous polynucleotide encoding an insect ADC, together with heterologous polynucleotide(s) encoding one or more 3-HP pathway genes of the 3-HP pathway that proceeds through PEP or pyruvate, OAA, aspartate, β-alanine, and malonate semialdehyde intermediates (as described in more detail below). In other embodiments, the yeast cells comprise a heterologous polynucleotide encoding an insect ADC or an ADC of the Class Bivalvia, Branchiopoda, Gastropoda, or Leptocardii, together with heterologous polynucleotide(s) encoding one or more 3-HP pathway genes of an additional 3-HP pathway, such as a 3-HP pathway that proceeds through pyruvate, acetyl-CoA, or malonyl-CoA; or a 3-HP pathway that pro-

TABLE 3

| | Q171S0 | B0WRQ9 | Q7PWN7 | G6DJC4 | D4AH66 | H9JRC8 | G4XH89 | G8FGR7 |
|---|---|---|---|---|---|---|---|---|
| Q171S0 | 100 | 96.24 | 93.98 | 84.96 | 84.96 | 83.46 | 81.95 | 78.63 |
| B0WRQ9 | 96.24 | 100 | 92.54 | 83.58 | 83.58 | 82.09 | 81.34 | 77.27 |
| Q7PWN7 | 93.98 | 92.54 | 100 | 82.84 | 84.33 | 82.84 | 81.34 | 78.79 |
| G6DJC4 | 84.96 | 83.58 | 82.84 | 100 | 94.78 | 93.28 | 91.04 | 88.64 |
| D4AH66 | 84.96 | 83.58 | 84.33 | 94.78 | 100 | 94.78 | 93.28 | 88.64 |
| H9JRC8 | 83.46 | 82.09 | 82.84 | 93.28 | 94.78 | 100 | 93.28 | 89.39 |
| G4XH89 | 81.95 | 81.34 | 81.34 | 91.04 | 93.28 | 93.28 | 100 | 89.39 |
| G8FGR7 | 78.63 | 77.27 | 78.79 | 88.64 | 88.64 | 89.39 | 89.39 | 100 |

Accordingly, in another aspect, the heterologous polynucleotide encodes an ADC, e.g., insect ADC, comprising a glutamine at a position corresponding to position 377 of the amino acid sequence of SEQ ID NO: 162, and a partial amino acid sequence having at least 75%, e.g., at least 80%, ceeds through glycerol and 3-HPA intermediates (as described in more detail below).

Any suitable 3-HP pathway can be used with the recombinant yeast cells having a heterologous polynucleotide encoding an insect ADC or an ADC of the Class Bivalvia, Branchiopoda, Gastropoda, or Leptocardii. 3-HP pathways, 3-HP pathway genes, and corresponding engineered transformants for fermentation of 3-HP are known in the art (e.g., U.S. 2012/0135481; U.S. Pat. No. 6,852,517; U.S. Pat. No. 7,309,597; U.S. 2001/0021978; U.S. 2008/0199926; WO 02/42418; and WO 10/031083; the contents of which are hereby incorporated in its entirety). An overview of several known 3-HP pathways is shown in FIG. 1.

In certain embodiments, the yeast cells provided herein have an active 3-HP pathway that proceeds through PEP or pyruvate, OAA, aspartate, β-alanine, and malonate semialdehyde intermediates (see, e.g., U.S. 2010/0021978, FIG. 1). In these embodiments, the yeast cells comprise a set of 3-HP pathway genes comprising one or more of pyruvate carboxylase (PYC), PEP carboxylase (PPC), aspartate aminotransferase (AAT), aspartate 1-decarboxylase (ADC), β-alanine aminotransferase (BAAT), aminobutyrate aminotransferase (gabT), 3-HP dehydrogenase (3-HPDH), 3-hydroxyisobutyrate dehydrogenase (HIBADH), and 4-hydroxybutyrate dehydrogenase genes. The 3-HP pathway genes may also include a PEP carboxykinase (PCK) gene that has been modified to produce a polypeptide that preferably catalyzes the conversion of PEP to OAA (native PCK genes generally produce a polypeptide that preferably catalyzes the reverse reaction of OAA to PEP).

Figure 4:
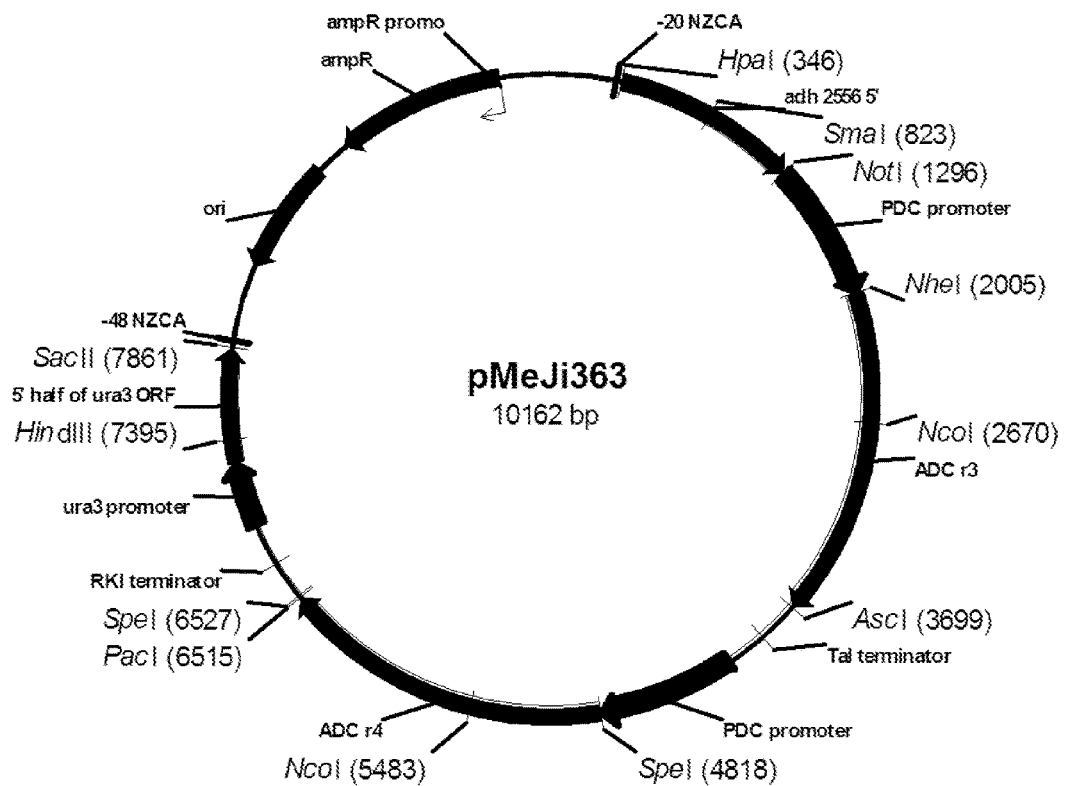
FIG. 4 shows a plasmid map for pMeJi363.

In certain embodiments, the yeast cells provided herein have an active 3-HP pathway that proceeds through PEP or pyruvate, OAA, and malate intermediates (see, e.g., U.S. 2010/0021978, FIG. 4). In these embodiments, the yeast cells comprise a set of 3-HP pathway genes comprising one or more of PPC, PYC, malate dehydrogenase, and malate decarboxylase genes. The 3-HP pathway genes may also include a PCK gene that has been modified to produce a polypeptide that preferably catalyzes the conversion of PEP to OAA. In certain embodiments, the yeast cells provided herein have an active 3-HP pathway that proceeds through PEP or pyruvate, OAA, and malonate semialdehyde intermediates (see, e.g., U.S. 2010/0021978, FIG. 1). In these embodiments, the yeast cells comprise a set of 3-HP pathway genes comprising one or more of PPC, PYC, 2-keto acid decarboxylase, alpha-ketoglutarate (AKG) decarboxylase (KGD), branched-chain alpha-keto acid decarboxylase (BCKA), indolepyruvate decarboxylase (IPDA), 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include a PDC gene and/or benzoylformate decarboxylase gene that have been modified to encode a polypeptide capable of catalyzing the conversion of OAA to malonate semialdehyde.

In certain embodiments, the yeast cells provided herein have an active 3-HP pathway that proceeds through PEP or pyruvate, OAA, malonyl-CoA, and malonate semialdehyde intermediates, wherein the malonate semialdehyde intermediate is optional (see, e.g., U.S. 2010/0021978, FIG. 2). In these embodiments, the yeast cells comprise a set of 3-HP pathway genes comprising one or more of PPC, PYC, OAA formate lyase, malonyl-CoA reductase, CoA acylating malonate semialdehyde dehydrogenase, 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include an OAA dehydrogenase gene derived by modifying a 2-keto-acid dehydrogenase gene to produce a polypeptide that catalyzes the conversion of OAA to malonyl-CoA.

In certain embodiments, the yeast cells provided herein have an active 3-HP pathway that proceeds through pyruvate, acetyl-CoA, malonyl-CoA, and malonate semialdehyde intermediates, wherein the malonate semialdehyde intermediate is optional (see, e.g., WO 02/042418, FIG. 44). In these embodiments, the yeast cells comprise a set of 3-HP pathway genes comprising one or more of pyruvate dehydrogenase (PDH), acetyl-CoA carboxylase (ACC), malonyl-CoA reductase, CoA acylating malonate semialdehyde dehydrogenase, 3-HPDH, HIBADH, and 4-hydroxybutyrate dehydrogenase genes.

In certain embodiments, the yeast cells provided herein have an active 3-HP pathway that proceeds through pyruvate, alanine, β-alanine, β-alanyl-CoA, acrylyl-CoA, 3-HP-CoA, and malonate semialdehyde intermediates, wherein the β-alanyl-CoA, acrylyl-CoA, 3-HP-CoA, and malonate semialdehyde intermediates are optional (β-alanine can be converted to 3-HP via a malonate semialdehyde intermediate or via β-alanyl-CoA, acrylyl-CoA, and 3-HP-CoA intermediates (see, e.g., U.S. Pat. No. 7,309,597, FIG. 1). In these embodiments, the yeast cells comprise a set of 3-HP pathway genes comprising one or more of alanine dehydrogenase, pyruvate/alanine aminotransferase, alanine 2,3-aminomutase, CoA transferase, CoA synthetase, β-alanyl-CoA ammonia lyase, 3-HP-CoA dehydratase, 3-HP-CoA hydrolase, 3-hydroxyisobutyryl-CoA hydrolase, BAAT, 3-HPDH, HIBADH, and 4-hydroxybutyrate dehydrogenase genes.

In certain embodiments, the yeast cells provided herein have an active 3-HP pathway that proceeds through pyruvate, lactate, lactyl-CoA, acrylyl-CoA, and 3-HP-CoA intermediates (see, e.g., WO 02/042418, FIG. 1). In these embodiments, the yeast cells comprise a set of 3-HP pathway genes comprising one or more of LDH, CoA transferase, CoA synthetase, lactyl-CoA dehydratase, 3-HP-CoA dehydratase, 3-HP-CoA hydrolase, and 3-hydroxyisobutyryl-CoA hydrolase genes.

In certain embodiments, the yeast cells provided herein have an active 3-HP pathway that proceeds through glycerol and 3-HPA intermediates (see, e.g., U.S. Pat. No. 6,852,517). In these embodiments, the yeast cells comprise a set of 3-HP pathway genes comprising one or more of glycerol dehydratase and aldehyde dehydrogenase genes.

In certain embodiments, the yeast cells provided herein have an active 3-HP pathway that proceeds through PEP or pyruvate, OAA, aspartate, β-alanine, β-alanyl-CoA, acrylyl-CoA, 3-HP-CoA, and alanine intermediates, wherein the OAA, aspartate, and alanine intermediates are optional (PEP or pyruvate can be converted to β-alanine via OAA and aspartate or via alanine) (see WO 02/042418, FIG. 54; U.S. Pat. No. 7,309,597, FIG. 1). In these embodiments, the yeast cells comprise a set of 3-HP pathway genes comprising one or more of PPC, PYC, AAT, ADC, CoA transferase, CoA synthetase, β-alanyl-CoA ammonia lyase, 3-HP-CoA dehydratase, 3-HP-CoA hydrolase, 3-hydroxyisobutyrl-CoA hydrolase, alanine dehydrogenase, pyruvate/alanine aminotransferase, and AAM genes. The 3-HP pathway genes may also include a PCK gene that has been modified to produce a polypeptide that preferably catalyzes the conversion of PEP to OAA.

In certain embodiments, the yeast cells provided herein express one or more 3-HP pathway genes encoding enzymes selected from the group consisting of ACC (catalyzes the conversion of acetyl-CoA to malonyl-CoA), alanine 2,3-aminomutase (AAM, catalyzes the conversion of alanine to β-alanine), alanine dehydrogenase (catalyzes the conversion of pyruvate to alanine), aldehyde dehydrogenase (catalyzes the conversion of 3-HPA to 3-HP), KGD (catalyzes the conversion of OAA to malonate semialdehyde), AAT (catalyzes the conversion of OAA to aspartate), ADC (catalyzes the conversion of aspartate to β-alanine), BCKA (catalyzes the conversion of OAA to malonate semialdehyde), BAAT (catalyzes the conversion of β-alanine to malonate semialdehyde), 4-aminobutyrate aminotransferase (gabT, catalyzes the conversion of β-alanine to malonate semialdehyde), β-alanyl-CoA ammonia lyase (catalyzes the conversion of β-alanyl-CoA to acrylyl-CoA), Co-A acylating malonate semialdehyde dehydrogenase (catalyzes the conversion of malonyl-CoA to malonate semialdehyde), CoA synthetase (catalyzes the conversion of β-alanine to β-alanyl-CoA or the conversion of lactate to lactyl-CoA), CoA transferase (catalyzes the conversion of β-alanine to β-alanyl-CoA and/or the conversion of lactate to lactyl-CoA), glycerol dehydratase (catalyzes the conversion of glycerol to 3-HPA), IPDA (catalyzes the conversion of OAA to malonate semialdehyde), LDH (catalyzes the conversion of pyruvate to lactate), lactyl-CoA dehydratase (catalyzes the conversion of lactyl-CoA to acrylyl-CoA), malate decarboxylase (catalyzes the conversion of malate to 3-HP), malate dehydrogenase (catalyzes the conversion of OAA to malate), malonyl-CoA reductase (catalyzes the conversion of malonyl-CoA to malonate semialdehyde or 3-HP), OAA formate lyase (also known as pyruvate-formate lyase and ketoacid formate-lyase, catalyzes the conversion of OAA to malonyl-CoA), OAA dehydrogenase (catalyzes the conversion of OAA to malonyl CoA); PPC (catalyzes the conversion of PEP to OAA), pyruvate/alanine aminotransferase (catalyzes the conversion of pyruvate to alanine), PYC (catalyzes the conversion of pyruvate to OAA), PDH (catalyzes the conversion of pyruvate to acetyl-CoA), 2-keto acid decarboxylase (catalyzes the conversion of OAA to malonate semialdehyde), 3-HP-CoA dehydratase (also known as acrylyl-CoA hydratase, catalyzes the conversion of acrylyl-CoA to 3-HP-CoA), 3-HPDH (catalyzes the conversion of malonate semialdehyde to 3-HP), 3-HP-CoA hydrolase (catalyzes the conversion of 3-HP-CoA to 3-HP), HIBADH (catalyzes the conversion of malonate semialdehyde to 3-HP), 3-hydroxyisobutyryl-CoA hydrolase (catalyzes the conversion of 3-HP-CoA to 3-HP), and 4-hydroxybutyrate dehydrogenase (catalyzes the conversion of malonate semialdehyde to 3-HP). For each of these enzyme activities, the reaction of interest in parentheses may be a result of endogenous or heterologous activity.

Any suitable 3-HP pathway gene, endogenous or heterologous, may be used and expressed in sufficient amount to produce an enzyme involved in a selected active 3-HP pathway. With the complete genome sequence available for now more than 550 species (with more than half of these available on public databases such as the NCBI), including 395 microorganism genomes and a variety of yeast, fungi, plant, and mammalian genomes, the identification of genes encoding the selected 3-HP pathway enzymatic activities taught herein is routine and well known in the art for a selected host. For example, suitable homologues, orthologs, paralogs and nonorthologous gene displacements of known genes, and the interchange of genetic alterations between organisms can be identified in a related or distant host to a selected host.

For yeasts without a known genome sequence, sequences for genes of interest (either as overexpression candidates or as insertion sites) can typically be obtained using techniques known in the art. Routine experimental design can be employed to test expression of various genes and activity of various enzymes, including genes and enzymes that function in a 3-HP pathway. Experiments may be conducted wherein each enzyme is expressed in the yeast individually and in blocks of enzymes up to and including preferably all pathway enzymes, to establish which are needed (or desired) for improved 3-HP production. One illustrative experimental design tests expression of each individual enzyme as well as of each unique pair of enzymes, and further can test expression of all required enzymes, or each unique combination of enzymes. A number of approaches can be taken, as will be appreciated.

The recombinant host cells of the invention can be produced by introducing heterologous polynucleotides encoding one or more of the enzymes participating in a 3-HP pathway, as described below. As one in the art will appreciate, in some instances (e.g., depending on the selection of host) the heterologous expression of every gene shown in the 3-HP pathway may not be required for 3-HP production given that a host cell may have endogenous enzymatic activity from one or more pathway genes. For example, if a chosen host is deficient in one or more enzymes of a 3-HP pathway, then heterologous polynucleotides for the deficient enzyme(s) are introduced into the host for subsequent expression. Alternatively, if the chosen host exhibits endogenous expression of some pathway genes, but is deficient in others, then an encoding polynucleotide is needed for the deficient enzyme(s) to achieve 3-HP biosynthesis. Thus, a recombinant host cell of the invention can be produced by introducing heterologous polynucleotides to obtain the enzyme activities of a desired biosynthetic pathway or a desired biosynthetic pathway can be obtained by introducing one or more heterologous polynucleotides (e.g., a polynucleotide that encodes an insect ADC) that, together with one or more endogenous enzymes, produces 3-HP.

Depending on the 3-HP pathway constituents of a selected recombinant host organism, the host cells of the invention will include at least one heterologous polynucleotide encoding an insect ADC or an ADC of the Class Bivalvia, Branchiopoda, Gastropoda, or Leptocardii, and up to all encoding heterologous polynucleotides for the ADC 3-HP pathway and/or another 3-HP pathway. In a host deficient in all enzymes of a 3-HP pathway, heterologous expression of all enzymes in the pathway can be included, although it is understood that all enzymes of a pathway can be expressed even if the host contains at least one of the pathway enzymes.

A "pyruvate carboxylase gene" or "PYC gene" as used herein refers to any gene that encodes a polypeptide with pyruvate carboxylase activity, meaning the ability to catalyze the conversion of pyruvate, $CO_2$, and ATP to OAA, ADP, and phosphate. In certain embodiments, a PYC gene may be derived from a yeast source. For example, the PYC gene may be derived from an *I. orientalis* PYC gene encoding the amino acid sequence set forth in SEQ ID NO: 2. In other embodiments, the gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 2. In certain embodiments, an *I. orientalis*-derived PYC gene may comprise the nucleotide sequence set forth in SEQ ID NO: 1 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO:

1. In other embodiments, the PYC gene may be derived from a bacterial source. For example, the PYC gene may be derived from one of the few bacterial species that use only PYC and not PPC (see below) for anaplerosis, such as *R. sphaeroides*, or from a bacterial species that possesses both PYC and PPC, such as *R. etli*. The amino acid sequences encoded by the PYC genes of *R. sphaeroides* and *R. etli* are set forth in SEQ ID NOs: 3 and 4, respectively. A PYC gene may be derived from a gene encoding the amino acid sequence of SEQ ID NO: 3 or 4, or from a gene encoding an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 3 or 4. Alternatively, the PYC gene may be derived from a PYC gene encoding an enzyme that does not have a dependence on acetyl-CoA for activation, such as a *P. fluorescens* PYC gene encoding the amino acid sequence set forth in SEQ ID NO: 5 (carboxytransferase subunit) or SEQ ID NO: 6 (biotin carboxylase subunit), a *C. glutamicum* PYC gene encoding the amino acid sequence set forth in SEQ ID NO: 7, or a gene encoding an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 5, 6, or 7. A PYC gene may also be derived from a PYC gene that encodes an enzyme that is not inhibited by aspartate, such as a *S. meliloti* PYC gene encoding the amino acid sequence set forth in SEQ ID NO: 8 (Sauer FEMS Microbiol Rev 29:765 (2005), or from a gene encoding an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 8.

A "PEP carboxylase gene" or "PPC gene" as used herein refers to any gene that encodes a polypeptide with PEP carboxylase activity, meaning the ability to catalyze the conversion of PEP and $CO_2$ to OAA and phosphate. In certain embodiments, a PPC gene may be derived from a bacterial PPC gene. For example, the PPC gene may be derived from an *E. coli* PPC gene encoding the amino acid sequence set forth in SEQ ID NO: 10 or an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 10. In certain embodiments, an *E. coli*-derived PPC gene may comprise the nucleotide sequence set forth in SEQ ID NO: 9 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 9. In other embodiments, a PPC gene may be derived from an "A" type PPC, found in many archea and a limited number of bacteria, that is not activated by acetyl CoA and is less inhibited by aspartate. For example, a PPC gene may be derived from a *M. thermoautotrophicum* PPC A gene encoding the amino acid sequence set forth in SEQ ID NO: 11, a *C. perfringens* PPC A gene encoding the amino acid sequence set forth in SEQ ID NO: 12, or a gene encoding an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 11 or 12. In certain of these embodiments, the gene may have undergone one or more mutations versus the native gene in order to generate an enzyme with improved characteristics. For example, the gene may have been mutated to encode a PPC polypeptide with increased resistance to aspartate feedback inhibition versus the native polypeptide. In other embodiments, the PPC gene may be derived from a plant source.

An "aspartate aminotransferase gene" or "AAT gene" as used herein refers to any gene that encodes a polypeptide with aspartate aminotransferase activity, meaning the ability to catalyze the conversion of OAA to aspartate. Enzymes having aspartate aminotransferase activity are classified as EC 2.6.1.1. In certain embodiments, an AAT gene may be derived from a yeast source such as *I. orientalis* or *S. cerevisiae*. For example, the AAT gene may be derived from an *I. orientalis* AAT gene encoding the amino acid sequence set forth in SEQ ID NO: 14 or a *S. cerevisiae* AAT2 gene encoding the amino acid sequence set forth in SEQ ID NO: 15. In other embodiments, the gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 14 or 15. In certain embodiments, an *I. orientalis*-derived AAT gene may comprise the nucleotide sequence set forth in SEQ ID NO: 13 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 13. In other embodiments, the AAT gene may be derived from a bacterial source. For example, the AAT gene may be derived from an *E. coli* aspC gene encoding a polypeptide comprising the amino acid sequence set forth in SEQ ID NO: 16. In other embodiments, the gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 16.

In addition to an insect ADC gene or an ADC gene of the Class Bivalvia, Branchiopoda, Gastropoda, or Leptocardii of the present invention, the yeast cell may comprise another ADC gene (an insect ADC gene, a non-insect ADC gene, or both). In some embodiments, the ADC gene may be derived from a *S. avermitilis* panD gene encoding the amino acid sequence set forth in SEQ ID NO: 17. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 17. In certain embodiments, a *S. avermitilis*-derived ADC gene may comprise the nucleotide sequence set forth in any one of SEQ ID NOs: 130, 145, 146, and 147; or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in any one of SEQ ID NOs: 130, 145, 146, and 147.

In other embodiments, the ADC gene may be derived from a *C. acetobutylicum* panD gene encoding the amino acid sequence set forth in SEQ ID NO: 18. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 18. In certain embodiments, a *C. acetobutylicum*-derived ADC gene may comprise the nucleotide sequence set forth in SEQ ID NO: 131, or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 131.

In other embodiments, the ADC gene may be derived from a *H. pylori* ADC gene encoding the amino acid sequence set forth in SEQ ID NO: 133. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 133. In certain embodiments, a *H. pylori*-derived ADC gene may comprise the nucleotide sequence set forth in SEQ ID NO: 132, or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 132.

In other embodiments, the ADC gene may be derived from a *Bacillus* sp. TS25 ADC gene encoding the amino acid sequence set forth in SEQ ID NO: 135. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 135. In certain embodiments, a *Bacillus* sp. TS25-derived ADC gene may comprise the nucleotide sequence set forth in SEQ ID NO: 134, or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 134.

In other embodiments, the ADC gene may be derived from a *C. glutamicum* ADC gene encoding the amino acid sequence set forth in SEQ ID NO: 137. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 137. In certain embodiments, a *C. glutamicum*-derived ADC gene may comprise the nucleotide sequence set forth in SEQ ID NO: 136, or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 136.

In other embodiments, the ADC gene may be derived from a *B. licheniformis* ADC gene encoding the amino acid sequence set forth in SEQ ID NO: 139. In some embodiments, the ADC gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 139. In certain embodiments, a *B. licheniformis*-derived ADC gene may comprise the nucleotide sequence set forth in any one of SEQ ID NOs: 138, 148, 149, 150, and 151; or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in any one of SEQ ID NOs: 138, 148, 149, 150, and 151.

A "β-alanine aminotransferase gene" or "BAAT gene" as used herein refers to any gene that encodes a polypeptide with β-alanine aminotransferase activity, meaning the ability to catalyze the conversion of β-alanine to malonate semialdehyde. Enzymes having β-alanine aminotransferase activity are classified as EC 2.6.1.19. In certain embodiments, a BAAT gene may be derived from a yeast source. For example, a BAAT gene may be derived from the *I. orientalis* homolog to the pyd4 gene encoding the amino acid sequence set forth in SEQ ID NO: 20. In some embodiments, the BAAT gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 20. In certain embodiments, an *I. orientalis*-derived BAAT gene may comprise the nucleotide sequence set forth in SEQ ID NO: 19 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 19. In other embodiments, the BAAT gene may be derived from the *S. kluyveri* pyd4 gene encoding the amino acid sequence set forth in SEQ ID NO: 21. In some embodiments, the BAAT gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 21. In certain embodiments, a *S. kluyveri*-derived BAAT gene may comprise the nucleotide sequence set forth in SEQ ID NO: 142 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 142. In other embodiments, the BAAT gene may be derived from a bacterial source. For example, a BAAT gene may be derived from a *S. avermitilis* BAAT gene encoding the amino acid sequence set forth in SEQ ID NO: 22. In some embodiments, the BAAT gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 22. In certain embodiments, a *S. avermitilis*-derived BAAT gene may comprise the nucleotide sequence set forth in SEQ ID NO: 140 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 140.

A BAAT gene may also be a "4-aminobutyrate aminotransferase" or "gabT gene" meaning that it has native activity on 4-aminobutyrate as well as β-alanine. Alternatively, a BAAT gene may be derived by random or directed engineering of a native gabT gene from a bacterial or yeast source to encode a polypeptide with BAAT activity. For example, a BAAT gene may be derived from the *S. avermitilis* gabT encoding the amino acid sequence set forth in SEQ ID NO: 23. In some embodiments, the *S. avermitilis*-derived BAAT gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 23. In other embodiments, a BAAT gene may be derived from the *S. cerevisiae* gabT gene UGA1 encoding the amino acid sequence set forth in SEQ ID NO: 24. In some embodiments, the *S. cerevisiae*-derived BAAT gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 24. In certain embodiments, a *S. cerevisiae*-derived BAAT gene may comprise the nucleotide sequence set forth in SEQ ID NO: 141 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 141.

A "3-HP dehydrogenase gene" or "3-HPDH gene" as used herein refers to any gene that encodes a polypeptide with 3-HP dehydrogenase activity, meaning the ability to catalyze the conversion of malonate semialdehyde to 3-HP. Enzymes having 3-HP dehydrogenase activity are classified as EC 1.1.1.59 if they utilize a NAD(H) cofactor, and as EC 1.1.1.298 if they utilize a NADP(H) cofactor. Enzymes classified as EC 1.1.1.298 are alternatively referred to as malonate semialdehyde reductases.

In certain embodiments, a 3-HPDH gene may be derived from a yeast source. For example, a 3-HPDH gene may be derived from the *I. orientalis* homolog to the YMR226C gene (e.g., the *I. orientalis* sequence encoding the amino acid sequence set forth in SEQ ID NO: 26). In some embodiments, the 3-HPDH gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 26. In certain embodiments, an *I. orientalis*-derived 3-HPDH gene may comprise the nucleotide sequence set forth in SEQ ID NO: 25 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 25. In other embodiments, a 3-HPDH gene may be derived from the *S. cerevisiae* YMR226C gene encoding the amino acid sequence set forth in SEQ ID NO: 129. In some embodiments, the 3-HPDH gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 129. In certain embodiments, a *S. cerevisiae*-derived 3-HPDH gene may comprise the nucleotide sequence set forth in SEQ ID NO: 144 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 144.

In other embodiments, the 3-HPDH gene may be derived from a bacterial source. For example, a 3-HPDH gene may be derived from an *E. coli* ydfG gene encoding the amino acid sequence in SEQ ID NO: 27. In some embodiments, the gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence of SEQ ID NO: 27. In certain embodiments, an *E. coli*-derived 3-HPDH gene may comprise the nucleotide sequence set forth in SEQ ID NO: 143 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 143. In other embodiments, a 3-HPDH gene may be derived from a *M. sedula* malonate semialdehyde reductase gene encoding the amino acid sequence set forth in SEQ ID NO: 29. In some embodiments, the 3-HPDH gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence set forth in SEQ ID NO: 29. In certain embodiments, a *M. sedula*-derived 3-HPDH gene may comprise the nucleotide sequence set forth in SEQ ID NO: 152 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 152.

In certain embodiments, a 3-HPDH gene may be a natural or engineered gene having an increased specificity for NAD(H) compared to NADP(H). 3-HPDA variants having increased specificity for NAD(H) are described in WO/2013/049073 (the content of which is incorporated herein by reference).

A "3-hydroxyisobutyrate dehydrogenase gene" or "HIBADH gene" as used herein refers to any gene that encodes a polypeptide with 3-hydroxyisobutyrate dehydrogenase activity, meaning the ability to catalyze the conversion of 3-hydroxyisobutyrate to methylmalonate semialdehyde. Enzymes having 3-hydroxyisobutyrate dehydrogenase activity are classified as EC 1.1.1.31. Some 3-hydroxyisobutyrate dehydrogenases also have 3-HPDH activity. In certain embodiments, a HIBADH gene may be derived from a bacterial source. For example, a HIBADH gene may be derived from an *A. faecalis* M3A gene encoding the amino acid sequence set forth in SEQ ID NO: 28, a *P. putida* KT2440 or E23440 mmsB gene encoding the amino acid sequence set forth in SEQ ID NO: 30 or SEQ ID NO: 31, respectively, or a *P. aeruginosa* PAO1 mmsB gene encoding the amino acid sequence set forth in SEQ ID NO: 32. In certain embodiments, a HIBADH gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence set forth in SEQ ID NO: 28, 30, 31, or 32.

A "4-hydroxybutyrate dehydrogenase gene" as used herein refers to any gene that encodes a polypeptide with 4-hydroxybutyrate dehydrogenase activity, meaning the ability to catalyze the conversion of 4-hydroxybutanoate to succinate semialdehyde. Enzymes having 4-hydroxybutyrate dehydrogenase activity are classified as EC 1.1.1.61. Some 4-hydroxybutyrate dehydrogenases also have 3-HPDH activity. In certain embodiments, a 4-hydroxybutyrate dehydrogenase gene may be derived from a bacterial source. For example, a 4-hydroxybutyrate dehydrogenase gene may be derived from a R. eutropha H16 4hbd gene encoding the amino acid sequence set forth in SEQ ID NO: 33 or a C. kluyveri DSM 555 hbd gene encoding the amino acid sequence set forth in SEQ ID NO: 34. In other embodiments, the gene may encode an amino acid sequence with at least 50%, at least 60%, at least 65%, at least 70%, at least 75%, at least 80%, at least 85%, at least 90%, at least 95%, at least 96%, at least 97%, at least 98%, or at least 99% sequence identity to the amino acid sequence set forth in SEQ ID NO: 33 or 34.

A "PEP carboxykinase gene" or "PCK gene" as used herein refers to any gene that encodes a polypeptide with PEP carboxykinase activity, meaning the ability to catalyze the conversion of PEP, $CO_2$, and ADP or GDP to OAA and ATP or GTP, or vice versa. Enzymes having PEP carboxykinase activity are classified as EC 4.1.1.32 (GTP/GDP utilizing) and EC 4.1.1.49 (ATP/ADP utilizing). In certain embodiments, a PCK gene may be derived from a yeast source. In other embodiments, a PCK gene may be derived from a bacterial source, and in certain of these embodiments the gene may be derived from bacteria in which the PCK reaction favors the production of OAA rather than the more common form of the reaction where decarboxylation is dominant. For example, a PCK gene may be derived from a M. succiniciproducens PCK gene encoding the amino acid sequence set forth in SEQ ID NO: 35, an A. succiniciproducens PCK gene encoding the amino acid sequence set forth in SEQ ID NO: 36, an A. succinogenes PCK gene encoding the amino acid sequence set forth in SEQ ID NO: 37, or a R. eutropha PCK gene encoding the amino acid sequence set forth in SEQ ID NO: 38. In other embodiments, a PCK gene has undergone one or more mutations versus the native gene from which it was derived, such that the resultant gene encodes a polypeptide that preferably catalyzes the conversion of PEP to OAA. For example, a PCK gene may be derived from an E. coli K12 strain PCK gene encoding the amino acid sequence set forth in SEQ ID NO: 39, where the gene has been mutated to preferably catalyze the conversion of PEP to OAA. In other embodiments the conversion of PEP to OAA is catalyzed by a PEP carboxytransphosphorylase such as is found in propionic acid bacteria (e.g., P. shermanii, A. woodii) which use inorganic phosphate and diphosphate rather than ATP/ADP or GTP/GDP.

A "malate dehydrogenase gene" as used herein refers to any gene that encodes a polypeptide with malate dehydrogenase activity, meaning the ability to catalyze the conversion of OAA to malate. In certain embodiments, a malate dehydrogenase gene may be derived from a bacterial or yeast source.

A "malate decarboxylase gene" as used herein refers to any gene that encodes a polypeptide with malate decarboxylase activity, meaning the ability to catalyze the conversion of malate to 3-HP. Malate decarboxylase activity is not known to occur naturally. Therefore, a malate decarboxylase gene may be derived by incorporating one or more mutations into a native source gene that encodes a polypeptide with acetolactate decarboxylase activity. Polypeptides with acetolactate decarboxylase activity catalyze the conversion of 2-hydroxy-2-methyl-3-oxobutanoate to 2-acetoin, and are classified as EC 4.1.1.5. In certain embodiments, a malate decarboxylase gene may be derived from a bacterial source. For example, a malate decarboxylase gene may be derived from a L. lactis aldB gene encoding the amino acid sequence set forth in SEQ ID NO: 40, a S. thermophilus aldB gene encoding the amino acid sequence set forth in SEQ ID NO: 41, a B. brevis aldB gene encoding the amino acid sequence set forth in SEQ ID NO: 42, or a E. aerogenes budA gene encoding the amino acid sequence set forth in SEQ ID NO: 43.

An "alpha-ketoglutarate (AKG) decarboxylase gene" or "KGD gene" as used herein refers to any gene that encodes a polypeptide with alpha-ketoglutarate decarboxylase activity, meaning the ability to catalyze the conversion of alpha-ketoglutarate (2-oxoglutarate) to succinate semialdehyde. Enzymes having AKG decarboxylase activity are classified as EC 4.1.1.71. A KGD gene may be used to derive a gene encoding a polypeptide capable of catalyzing the conversion of OAA to malonate semialdehyde. This activity may be found in a native KGD gene, or it may derived by incorporating one or more mutations into a native KGD gene. In certain embodiments, a KGD gene may be derived from a bacterial source. For example, a KGD gene may be derived from a M. tuberculosis KGD gene encoding the amino acid sequence set forth in SEQ ID NO: 44, a B. japonicum KGD gene encoding the amino acid sequence set forth in SEQ ID NO: 45, or a M. loti (aka Rhizobium loti) KGD gene encoding the amino acid sequence set forth in SEQ ID NO: 46.

A "branched-chain alpha-keto acid decarboxylase gene" or "BCKA gene" as used herein refers to any gene that encodes a polypeptide with branched-chain alpha-keto acid decarboxylase activity, which can serve to decarboxylate a range of alpha-keto acids from three to six carbons in length. Enzymes having BCKA activity are classified as EC 4.1.1.72. A BCKA gene may be used to derive a gene encoding a polypeptide capable of catalyzing the conversion of OAA to malonate semialdehyde. This activity may be found in a native BCKA gene, or it may be derived by incorporating one or more mutations into a native BCKA gene. In certain embodiments, a BCKA gene may be derived from a bacterial source. For example, a BCKA gene may be derived from a L. lactis kdcA gene encoding the amino acid sequence set forth in SEQ ID NO: 47.

An "indolepyruvate decarboxylase gene" or "IPDA gene" as used herein refers to any gene that encodes a polypeptide with indolepyruvate decarboxylase activity, meaning the ability to catalyze the conversion of indolepyruvate to indoleacetaldehyde. Enzymes having IPDA activity are classified as EC 4.1.1.74. An IPDA gene may be used to derive a gene encoding a polypeptide capable of catalyzing the conversion of OAA to malonate semialdehyde. This activity may be found in a native IPDA gene, or it may be derived by incorporating one or more mutations into a native IPDA gene. In certain embodiments, an indolepyruvate decarboxylase gene may be derived from a yeast, bacterial, or plant source.

A "pyruvate decarboxylase gene" or "PDC gene" as used herein refers to any gene that encodes a polypeptide with pyruvate decarboxylase activity, meaning the ability to catalyze the conversion of pyruvate to acetaldehyde. Enzymes having PDC activity are classified as EC 4.1.1.1. In preferred embodiments, a PDC gene that is incorporated into a modified yeast cell as provided herein has undergone one or more mutations versus the native gene from which it was derived such that the resultant gene encodes a polypeptide capable of catalyzing the conversion of OAA to malonate semialdehyde. In certain embodiments, a PDC gene may be derived from a yeast source. For example, a PDC gene may be derived from an I. orientalis PDC gene encoding the amino acid sequence set forth in SEQ ID NO: 49, a S.

*cerevisiae* PDC1 gene encoding the amino acid sequence set forth in SEQ ID NO: 50, or a *K. lactis* PDC encoding the amino acid sequence set forth in SEQ ID NO: 51. In certain embodiments, a PDC gene derived from the *I. orientalis* PDC gene may comprise the nucleotide sequence set forth in SEQ ID NO: 48 or a nucleotide sequence with at least 50%, at least 60%, at least 65%, at least 70%, at least 75%, at least 80%, at least 85%, at least 90%, at least 95%, at least 96%, at least 97%, at least 98%, or at least 99% sequence identity to the nucleotide sequence set forth in SEQ ID NO: 48. In other embodiments, a PDC gene may be derived from a bacterial source. For example, a PDC gene may be derived from a *Z. mobilis* PDC gene encoding the amino acid sequence set forth in SEQ ID NO: 52 or an *A. pasteurianus* PDC gene encoding the amino acid sequence set forth in SEQ ID NO: 53.

A "benzoylformate decarboxylase" gene as used herein refers to any gene that encodes a polypeptide with benzoylformate decarboxylase activity, meaning the ability to catalyze the conversion of benzoylformate to benzaldehyde. Enzymes having benzoylformate decarboxylase activity are classified as EC 4.1.1.7. In preferred embodiments, a benzoylformate decarboxylase gene that is incorporated into a modified yeast cell as provided herein has undergone one or more mutations versus the native gene from which it was derived such that the resultant gene encodes a polypeptide capable of catalyzing the conversion of OAA to malonate semialdehyde. In certain embodiments, a benzoylformate decarboxylase gene may be derived from a bacterial source. For example, a benzoylformate decarboxylase gene may be derived from a *P. putida* mdlC gene encoding the amino acid sequence set forth in SEQ ID NO: 54, a *P. aeruginosa* mdlC gene encoding the amino acid sequence set forth in SEQ ID NO: 55, a *P. stutzeri* dpgB gene encoding the amino acid sequence set forth in SEQ ID NO: 56, or a *P. fluorescens* ilvB-1 gene encoding the amino acid sequence set forth in SEQ ID NO: 57.

An "OAA formate lyase gene" as used herein refers to any gene that encodes a polypeptide with OAA formate lyase activity, meaning the ability to catalyze the conversion of an acylate ketoacid to its corresponding CoA derivative. A polypeptide encoded by an OAA formate lyase gene may have activity on pyruvate or on another ketoacid. In certain embodiments, an OAA formate lyase gene encodes a polypeptide that converts OAA to malonyl-CoA.

A "malonyl-CoA reductase gene" as used herein refers to any gene that encodes a polypeptide with malonyl-CoA reductase activity, meaning the ability to catalyze the conversion of malonyl-CoA to malonate semialdehyde (also referred to as Co-A acylating malonate semialdehyde dehydrogenase activity). In certain embodiments, a malonyl-CoA reductase gene may be derived from a bifunctional malonyl-CoA reductase gene which also has the ability to catalyze the conversion of malonate semialdehyde to 3-HP. In certain of these embodiments, a malonyl-CoA reductase gene may be derived from a bacterial source. For example, a malonyl-CoA reductase gene may be derived from a *C. aurantiacus* malonyl-CoA reductase gene encoding the amino acid sequence set forth in SEQ ID NO: 58, a *R. castenholzii* malonyl-CoA reductase gene encoding the amino acid sequence set forth in SEQ ID NO: 59, or an *Erythrobacter* sp. NAP1 malonyl-CoA reductase gene encoding the amino acid sequence set forth in SEQ ID NO: 60. In other embodiments, a malonyl-CoA reductase gene may be derived from a malonyl-CoA reductase gene encoding a polypeptide that only catalyzes the conversion of malonyl-CoA to malonate semialdehyde. For example, a malonyl-CoA reductase gene may be derived from a *M. sedula* Msed_0709 gene encoding the amino acid sequence set forth in SEQ ID NO: 61 or a *S. tokodaii* malonyl-CoA reductase encoding the amino acid sequence set forth in SEQ ID NO: 62.

A "pyruvate dehydrogenase gene" or "PDH gene" as used herein refers to any gene that encodes a polypeptide with pyruvate dehydrogenase activity, meaning the ability to catalyze the conversion of pyruvate to acetyl-CoA. In certain embodiments, a PDH gene may be derived from a yeast source. For example, a PDH gene may be derived from a *S. cerevisiae* LAT1, PDA1, PDB1, or LPD gene encoding the amino acid sequence set forth in SEQ ID NOs: 63-66, respectively. In other embodiments, a PDH gene may be derived from a bacterial source. For example, a PDH gene may be derived from an *E. coli* strain K12 substr. MG1655 aceE, aceF, or lpd gene encoding the amino acid sequence set forth in SEQ ID NOs: 67-69, respectively, or a *B. subtilis* pdhA, pdhB, pdhC, or pdhD gene encoding the amino acid sequence set forth in SEQ ID NOs: 70-73, respectively.

An "acetyl-CoA carboxylase gene" or "ACC gene" as used herein refers to any gene that encodes a polypeptide with acetyl-CoA carboxylase activity, meaning the ability to catalyze the conversion of acetyl-CoA to malonyl-CoA. Enzymes having acetyl-CoA carboxylase activity are classified as EC 6.4.1.2. In certain embodiments, an acetyl-CoA carboxylase gene may be derived from a yeast source. For example, an acetyl-CoA carboxylase gene may be derived from a *S. cerevisiae* ACC1 gene encoding the amino acid sequence set forth in SEQ ID NO: 74. In other embodiments, an acetyl-CoA carboxylase gene may be derived from a bacterial source. For example, an acetyl-CoA carboxylase gene may be derived from an *E. coli* accA, accB, accC, or accD gene encoding the amino acid sequence set forth in SEQ ID NOs: 75-78, respectively, or a *C. aurantiacus* accA, accB, accC, or accD gene encoding the amino acid sequence set forth in SEQ ID NOs: 79-82, respectively.

An "alanine dehydrogenase gene" as used herein refers to any gene that encodes a polypeptide with alanine dehydrogenase activity, meaning the ability to catalyze the NAD-dependent reductive amination of pyruvate to alanine. Enzymes having alanine dehydrogenase activity are classified as EC 1.4.1.1. In certain embodiments, an alanine dehydrogenase gene may be derived from a bacterial source. For example, an alanine dehydrogenase gene may be derived from a *B. subtilis* alanine dehydrogenase gene encoding the amino acid sequence set forth in SEQ ID NO: 83.

A "pyruvate/alanine aminotransferase gene" as used herein refers to any gene that encodes a polypeptide with pyruvate/alanine aminotransferase activity, meaning the ability to catalyze the conversion of pyruvate and L-glutamate to alanine and 2-oxoglutarate. In certain embodiments, a pyruvate/alanine aminotransferase gene is derived from a yeast source. For example, a pyruvate/alanine aminotransferase gene may be derived from a *S. pombe* pyruvate/alanine aminotransferase gene encoding the amino acid sequence set forth in SEQ ID NO: 84 or a *S. cerevisiae* ALT2 gene encoding the amino acid sequence set forth in SEQ ID NO: 85.

An "alanine 2,3-aminomutase gene" or "AAM gene" as used herein refers to a gene that encodes a polypeptide with alanine 2,3-aminomutase activity, meaning the ability to catalyze the conversion of alanine to β-alanine. Alanine 2,3 aminomutase activity is not known to occur naturally. Therefore, an alanine 2,3-aminomutase gene can be derived by incorporating one or more mutations into a native source gene that encodes a polypeptide with similar activity such as lysine 2,3 aminomutase activity (see, e.g., U.S. Pat. No. 7,309,597). In certain embodiments, the native source gene may be a *B. subtilis* lysine 2,3 aminomutase gene encoding the amino acid sequence set forth in SEQ ID NO: 86, a *P. gingivalis* lysine 2,3 aminomutase gene encoding the amino acid sequence set forth in SEQ ID NO: 87, or a *F. nucleatum* (ATCC 10953) lysine 2,3 aminomutase gene encoding the amino acid sequence set forth in SEQ ID NO: 88.

A "CoA transferase gene" as used herein refers to any gene that encodes a polypeptide with CoA transferase activity, which in one example includes the ability to catalyze the conversion of β-alanine to β-alanyl-CoA and/or the conversion of lactate to lactyl-CoA. In certain embodiments, a CoA transferase gene may be derived from a yeast source. In other embodiments, a CoA transferase gene may be derived from a bacterial source. For example, a CoA transferase gene may be derived from a *M. elsdenii* CoA transferase gene encoding the amino acid sequence set forth in SEQ ID NO: 89.

A "CoA synthetase gene" as used herein refers to any gene that encodes a polypeptide with CoA synthetase activity. In one example this includes the ability to catalyze the conversion of β-alanine to β-alanyl-CoA. In another example, this includes the ability to catalyze the conversion of lactate to lactyl-CoA. In certain embodiments, a CoA synthetase gene may be derived from a yeast source. For example, a CoA synthetase gene may be derived from a *S. cerevisiae* CoA synthetase gene. In other embodiments, a CoA synthetase gene may be derived from a bacterial source. For example, a CoA synthetase gene may be derived from an *E. coli*, *R. sphaeroides*, or *S. enterica* CoA synthetase gene.

A "β-alanyl-CoA ammonia lyase gene" as used herein refers to any gene that encodes a polypeptide with β-alanyl-CoA ammonia lyase activity, meaning the ability to catalyze the conversion of β-alanyl-CoA to acrylyl-CoA. In certain embodiments, a β-alanyl-CoA ammonia lyase gene may be derived from a bacterial source, such as a *C. propionicum* β-alanyl-CoA ammonia lyase gene encoding the amino acid sequence set forth in SEQ ID NO: 90.

A "3-HP-CoA dehydratase gene" or "acrylyl-CoA hydratase gene" as used herein refers to any gene that encodes a polypeptide with 3-HP-CoA dehydratase gene activity, meaning the ability to catalyze the conversion of acrylyl-CoA to 3-HP-CoA. Enzymes having 3-HP-CoA dehydratase activity are classified as EC 4.2.1.116. In certain embodiments, a 3-HP-CoA dehydratase gene may be derived from a yeast or fungal source, such as a *P. sojae* 3-HP-CoA dehydratase gene encoding the amino acid sequence set forth in SEQ ID NO: 91. In other embodiments, a 3-HP-CoA dehydratase gene may be derived from a bacterial source. For example, a 3-HP-CoA dehydratase gene may be derived from a *C. aurantiacus* 3-HP-CoA dehydratase gene encoding the amino acid sequence set forth in SEQ ID NO: 92, a *R. rubrum* 3-HP-CoA dehydratase gene encoding the amino acid sequence set forth in SEQ ID NO: 93, or a *R. capsulates* 3-HP-CoA dehydratase gene encoding the amino acid sequence set forth in SEQ ID NO: 94. In still other embodiments, a 3-HP-CoA dehydratase gene may be derived from a mammalian source. For example, a 3-HP-CoA dehydratase gene may be derived from a *H. sapiens* 3-HP-CoA dehydratase gene encoding the amino acid sequence set forth in SEQ ID NO: 95.

A "3-HP-CoA hydrolase gene" as used herein refers to any gene that encodes a polypeptide with 3-HP-CoA hydrolase activity, meaning the ability to catalyze the conversion of 3-HP-CoA to 3-HP. In certain embodiments, a 3-HP-CoA gene may be derived from a yeast or fungal source. In other embodiments, a 3-HP-CoA gene may be derived from a bacterial or mammalian source.

A "3-hydroxyisobutyryl-CoA hydrolase gene" as used herein refers to any gene that encodes a polypeptide with 3-hydroxyisobutyryl-CoA hydrolase activity, which in one example includes the ability to catalyze the conversion of 3-HP-CoA to 3-HP. In certain embodiments, a 3-hydroxyisobutyryl-CoA hydrolase gene may be derived from a bacterial source, such as a *P. fluorescens* 3-hydroxyisobutyryl-CoA hydrolase gene encoding the amino acid sequence set forth in SEQ ID NO: 96 or a *B. cereus* 3-hydroxyisobutyryl-CoA hydrolase gene encoding the amino acid sequence set forth in SEQ ID NO: 97. In other embodiments, a 3-hydroxyisobutyryl-CoA hydrolase gene may be derived from a mammalian source, such as a *H. sapiens* 3-hydroxyisobutyryl-CoA hydrolase gene encoding the amino acid sequence set forth in SEQ ID NO: 98.

A "lactate dehydrogenase gene" or "LDH gene" as used herein refers to any gene that encodes a polypeptide with lactate dehydrogenase activity, meaning the ability to catalyze the conversion of pyruvate to lactate. In certain embodiments, a LDH gene may be derived from a fungal, bacterial, or mammalian source.

A "lactyl-CoA dehydratase gene" as used herein refers to any gene that encodes a polypeptide with lactyl-CoA dehydratase activity, meaning the ability to catalyze the conversion of lactyl-CoA to acrylyl-CoA. In certain embodiments, a lactyl-CoA dehydratase gene may be derived from a bacterial source. For example, a lactyl-CoA dehydratase gene may be derived from a *M. elsdenii* lactyl-CoA dehydratase E1, EIIa, or EIIb subunit gene encoding the amino acid sequence set forth in SEQ ID NOs: 99-101.

An "aldehyde dehydrogenase gene" as used herein refers to any gene that encodes a polypeptide with aldehyde dehydrogenase activity, which in one example includes the ability to catalyze the conversion of 3-HPA to 3-HP and vice versa. In certain embodiments, an aldehyde dehydrogenase gene may be derived from a yeast source, such as a *S. cerevisiae* aldehyde dehydrogenase gene encoding the amino acid sequence set forth in SEQ ID NO: 102 or an *I. orientalis* aldehyde dehydrogenase gene encoding the amino acid sequence set forth in SEQ ID NO: 122, 124, or 126. SEQ ID NOs: 121, 123, and 125 are the coding sequences for SEQ ID NOs 122, 124, and 126, respectively. In other embodiments, an aldehyde dehydrogenase may be derived from a bacterial source, such as an *E. coli* aldH gene encoding the amino acid sequence set forth in SEQ ID NO: 103 or a *K. pneumoniae* aldehyde dehydrogenase gene encoding the amino acid sequence set forth in SEQ ID NO: 104.

A "glycerol dehydratase gene" as used herein refers to any gene that encodes a polypeptide with glycerol dehydratase activity, meaning the ability to catalyze the conversion of glycerol to 3-HPA. In certain embodiments, a glycerol dehydratase gene may be derived from a bacterial source, such as a *K. pneumonia* or *C. freundii* glycerol dehydratase gene.

The enzymes of the selected active 3-HP pathway, and activities thereof, can be detected using methods known in the art or as described herein. These detection methods may include use of specific antibodies, formation of an enzyme product, or disappearance of an enzyme substrate. See, for example, Sambrook et al., *Molecular Cloning: A Laboratory Manual*, Third Ed., Cold Spring Harbor Laboratory, New York (2001); Ausubel et al., *Current Protocols in Molecular*

*Biology,* John Wiley and Sons, Baltimore, Md. (1999); and Hanai et al., 2007, *Appl. Environ. Microbiol.* 73: 7814-7818).

Hosts, Expression Vectors and Nucleic Acid Constructs

The recombinant yeast cell may be any yeast cell capable of producing 3-HP when expressing a heterologous polynucleotide encoding an insect ADC or an ADC of the Class Bivalvia, Branchiopoda, Gastropoda, or Leptocardii. Those skilled in the art will understand that the genetic alterations, including metabolic modifications exemplified herein, may be described with reference to a suitable host organism such as *I. orientalis* and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other yeast organisms. For example, the *I. orientalis* metabolic alterations exemplified herein can readily be applied to other species by incorporating the same or analogous encoding nucleic acid from species other than the referenced species.

"Yeast" as used herein includes ascosporogenous yeast (Endomycetales), basidiosporogenous yeast, and yeast belonging to the Fungi Imperfecti (Blastomycetes). Since the classification of yeast may change in the future, for the purposes described herein, yeast shall be defined as described in *Biology and Activities of Yeast* (Skinner, F. A., Passmore, S. M., and Davenport, R. R., eds, *Soc. App. Bacteriol. Symposium Series* No. 9, 1980).

The yeast host cell may be a *Candida, Hansenula, Issatchenkia, Kluyveromyces, Pichia, Saccharomyces, Schizosaccharomyces,* or *Yarrowia* cell, such as a *Candida sonorensis, Candida methanosorbosa, Candida ethanolica, Issatchenkia orientalis, Kluyveromyces lactis, Kluyveromyces marxianus, Pichia fermentans, Pichia galeiformis, Pichia membranifaciens, Pichia deserticola, Saccharomyces carlsbergensis, Saccharomyces cerevisiae, Saccharomyces diastaticus, Saccharomyces bulderi, Saccharomyces douglasii, Saccharomyces kluyveri, Saccharomyces norbensis, Saccharomyces oviformis,* or *Yarrowia lipolytica* cell.

The yeast host cell may be engineered or derived from a cell that has been genetically modified to produce high lactic acid titers, exhibit increased tolerance to acidic pH, exhibit increased tolerance to ethanol or propanol, and/or display increased ability to ferment pentose sugars (yet, in some embodiments, the yeast cell is unable to ferment pentose sugars). Exemplary genetically modified yeast cells are described in WO 00/071738, WO 03/049525, WO 03/102201, WO 03/102152, WO 02/42471, WO 07/032792, WO 07/106524, and WO 07/117282, the contents of which are hereby incorporated by reference with respect to said cells. The modification of any yeast cell described in the foregoing applications is contemplated with an active 3-HP pathway as described herein.

The yeast host cell may be a Crabtree-positive phenotype or a Crabtree-negative phenotype. Crabtree-negative organisms are characterized by the ability to be induced into an increased fermentative state. Both naturally occurring organisms and recombinant organisms can be characterized as Crabtree-negative. The Crabtree effect is defined as oxygen consumption inhibition in a microorganism when the microorganism is cultured under aerobic conditions in the presence of a high concentration of glucose (e.g. >5 mM glucose). Crabtree-positive organisms continue to ferment (rather than respire) irrespective of oxygen availability in the presence of glucose, while Crabtree-negative organisms do not exhibit glucose-mediated inhibition of oxygen consumption. This characteristic is useful for organic product synthesis, since it permits cells to be grown at high substrate concentrations but to retain the beneficial energetic effects of oxidative phosphorylation. In another aspect, the yeast has a Crabtree-negative phenotype.

In certain embodiments, the yeast cells provided herein are 3-HP resistant yeast cells, as described in WO 2012/074818. A "3-HP-resistant yeast cell" as used herein refers to a yeast cell that exhibits an average glycolytic rate of at least 2.5 g/L/hr in media containing 75 g/L or greater 3-HP at a pH of less than 4.0. Such rates and conditions represent an economic process for producing 3-HP. In certain of these embodiments, the yeast cells may exhibit 3-HP resistance in their native form. In other embodiments, the cells may have undergone mutation and/or selection (e.g., chemostat selection or repeated serial subculturing) before, during, or after introduction of genetic modifications related to an active 3-HP pathway, such that the mutated and/or selected cells possess a higher degree of resistance to 3-HP than wild-type cells of the same species. For example, in some embodiments, the cells have undergone mutation and/or selection in the presence of 3-HP or lactic acid before being genetically modified with one or more heterologous 3-HP pathway genes. In certain embodiments, mutation and/or selection may be carried out on cells that exhibit 3-HP resistance in their native form. Cells that have undergone mutation and/or selection may be tested for sugar consumption and other characteristics in the presence of varying levels of 3-HP in order to determine their potential as industrial hosts for 3-HP production. In addition to 3-HP resistance, the yeast cells provided herein may have undergone mutation and/or selection for resistance to one or more additional organic acids (e.g., lactic acid) or to other fermentation products, byproducts, or media components.

Selection, such as selection for resistance to 3-HP or to other compounds, may be accomplished using methods well known in the art. For example, as mentioned supra, selection may be chemostat selection. Chemostat selection uses a chemostat that allows for a continuous culture of microorganisms (e.g., yeast) wherein the specific growth rate and cell number can be controlled independently. A continuous culture is essentially a flow system of constant volume to which medium is added continuously and from which continuous removal of any overflow can occur. Once such a system is in equilibrium, cell number and nutrient status remain constant, and the system is in a steady state. A chemostat allows control of both the population density and the specific growth rate of a culture through dilution rate and alteration of the concentration of a limiting nutrient, such as a carbon or nitrogen source. By altering the conditions as a culture is grown (e.g., decreasing the concentration of a secondary carbon source necessary to the growth of the inoculum strain, among others), microorganisms in the population that are capable of growing faster at the altered conditions will be selected and will outgrow microorganisms that do not function as well under the new conditions. Typically such selection requires the progressive increase or decrease of at least one culture component over the course of growth of the chemostat culture. The operation of chemostats and their use in the directed evolution of microorganisms is well known in the art (see, e.g., Novick, 1950, *Proc. Natl. Acad. Sci. USA* 36: 708-719, Harder, 1977, *J. Appl. Bacteriol.* 43: 1-24). Other methods for selection include, but are not limited to, repeated serial subculturing under the selective conditions as described in, e.g., U.S. Pat.

No. 7,629,162. Such methods can be used in place of, or in addition to, using the glucose limited chemostat method described above.

Yeast strains exhibiting the best combinations of growth and glucose consumption in 3-HP media as disclosed in, e.g., WO 2012/074818, are preferred host cells for various genetic modifications relating to 3-HP pathways. Yeast genera that possess the potential for a relatively high degree of 3-HP resistance, as indicated by growth in the presence of 75 g/L 3-HP or higher at a pH of less than 4, include for example *Candida, Issatchenkia, Kluyveromyces, Pichia, Saccharomyces, Schizosaccharomyces, Torulaspora,* and *Zygosaccharomyces*. Species exhibiting 3-HP resistance include *I. orientalis* (also known as *C. krusei*), *C. lambica* (also known as *Pichia fermentans*), and *S. bulderi* (also known as *Kazachstania bulderi*). *I. orientalis* and *C. lambica* are from the *I. orientalis/P. fermentans* clade, while *S. bulderi* is from the *Saccharomyces* clade. Specific strains exhibiting 3-HP resistance include *I. orientalis* strains 24210, PTA-6658, 60585, and CD1822, *S. bulderi* strains MYA-402 and MYA-404, and *C. lambica* strain ATCC 38617.

Other wild-type yeast or fungi may be tested in a similar manner and identified to have acceptable levels of growth and glucose utilization in the presence of high levels of 3-HP as described herein. For example, Gross and Robbins, 2000, *Hydrobiologia* 433(103): 91-109, have compiled a list of 81 fungal species identified in low pH (<4) environments that could be relevant to test as potential production hosts.

In certain embodiments, the modified yeast cells provided herein are generated by incorporating one or more genetic modifications into a Crabtree-negative host yeast cell. In certain of these embodiments the host yeast cell belongs to the genus *Candida, Issatchenkia,* or *Saccharomyces*, and in certain of these embodiments the host cell belongs to the *I. orientalis/P. fermentans* or *Saccharomyces* clade. In certain embodiments, the host cell is *I. orientalis, C. lambica,* or *S. bulderi*.

The *I. orientalis/P. fermentans* clade is the most terminal clade that contains at least the species *I. orientalis, P. galeiformis*, P. sp. YB-4149 (NRRL designation), *C. ethanolica, P. deserticola, P. membranifaciens,* and *P. fermentans*. Members of the *I. orientalis/P. fermentans* clade are identified by analysis of the variable D1/D2 domain of the 26S ribosomal DNA of yeast species, using the method described by Kurtzman and Robnett in "Identification and Phylogeny of Ascomycetous Yeasts from Analysis of Nuclear Large Subunit (26S) Ribosomal DNA Partial Sequences," *Antonie van Leeuwenhoek* 73: 331-371, 1998, incorporated herein by reference (see especially p. 349). Analysis of the variable D1/D2 domain of the 26S ribosomal DNA from hundreds of ascomycetes has revealed that the *I. orientalis/P. fermentans* clade contains very closely related species. Members of the *I. orientalis/P. fermentans* clade exhibit greater similarity in the variable D1/D2 domain of the 26S ribosomal DNA to other members of the clade than to yeast species outside of the clade. Therefore, other members of the *I. orientalis/P. fermentans* clade can be identified by comparison of the D1/D2 domains of their respective ribosomal DNA and comparison to other members of the clade and closely related species outside of the clade, using the Kurtzman and Robnett's methods.

In certain embodiments, the recombinant yeast cells provided herein belong to the genus *Issatchenkia*, and in certain of these embodiments the yeast cells are *I. orientalis*. When first characterized, the species *I. orientalis* was assigned the name *Pichia kudriavzevii*. The anamorph (asexual form) of *I. orientalis* is known as *Candida krusei*. Numerous additional synonyms for the species *I. orientalis* have been listed elsewhere (Kurtzman and Fell, The Yeasts, a Taxonomic Study. Section 35. *Issatchenkia Kudryavtsev*, pp 222-223 (1998)).

In certain embodiments, the yeast cells are *I. orientalis* CNB1 yeast cells. *I. orientalis* CNB1 yeast cells are described in WO 2012/074818 (the content of which is incorporated herein by reference) and include the *I. orientalis* CNB1 yeast cells described therein and any yeast cells derived from the *I. orientalis* CNB1 yeast cells described therein.

Genes that could be used as potential *I. orientalis* integration loci include, but are not limited to, an alcohol dehydrogenase gene (adh2556, SEQ ID NO: 105) encoding the polypeptide of SEQ ID NO: 106, an alternate alcohol dehydrogenase gene (adh9091, SEQ ID NO: 107) encoding the polypeptide of SEQ ID NO: 108, a second alternate alcohol dehydrogenase gene (adh1202, SEQ ID NO: 109) encoding the polypeptide of SEQ ID NO: 110, a cysteine aminopeptidase gene (gal6, SEQ ID NO: 111) encoding the polypeptide of SEQ ID NO: 112, an L-lactate cytochrome-c oxidoreductase gene (cyb2A, SEQ ID NO: 113) encoding the polypeptide of SEQ ID NO: 114, an alternate L-lactate cytochrome-c oxidoreductase gene (cyb2B, SEQ ID NO: 115) encoding the polypeptide of SEQ ID NO: 116, the glycerol 3-phosphate dehydrogenase gene (gpd, SEQ ID NO: 117) encoding the polypeptide of SEQ ID NO: 118, an aldehyde dehydrogenase gene (ald5680, SEQ ID NO: 119) encoding the polypeptide of SEQ ID NO: 120, an alternate aldehyde dehydrogenase gene (SEQ ID NO: 121) encoding the polypeptide of SEQ ID NO: 122, an alternate aldehyde dehydrogenase gene (SEQ ID NO: 123) encoding the polypeptide of SEQ ID NO: 124, an alternate aldehyde dehydrogenase gene (SEQ ID NO: 125) encoding the polypeptide of SEQ ID NO: 126, or a phosphoenolpyruvate carboxykinase gene (pck1, SEQ ID NO: 127) encoding the polypeptide of SEQ ID NO: 128.

The ideal yeast cell for 3-HP production is capable of growing at low pH levels. The ability to conduct fermentation at a low pH decreases downstream recovery costs, resulting in more economical production. Therefore, in certain embodiments the yeast host cell is capable of growing at low pH levels (e.g., at pH levels less than 7, 6, 5, 4, or 3).

A suitable host cell may possess one or more favorable characteristics in addition to 3-HP resistance and/or low pH growth capability. For example, potential host cells exhibiting 3-HP resistance may be further selected based on glycolytic rates, specific growth rates, thermotolerance, tolerance to biomass hydrolysate inhibitors, overall process robustness, and so on. These criteria may be evaluated prior to any genetic modification relating to a 3-HP pathway, or they may be evaluated after one or more such modifications have taken place.

Because most yeasts naturally produce ethanol, elimination or severe reduction in the enzyme catalyzing the first step in ethanol production from pyruvate (PDC) is favored for sufficient yield of an alternate product. In Crabtree-positive yeast, such as *Saccharomyces*, a disrupted PDC gene causes the host to acquire an auxotrophy for two-carbon compounds such as ethanol or acetate, and causes a lack of growth in media containing glucose. Mutants capable of overcoming these limitations can be obtained using progressive selection for acetate independence and glucose tolerance (see, e.g., van Maris Appl Environ Microbiol 70:159 (2004)). Therefore, in certain embodiments a preferred yeast host cell is a Crabtree-negative yeast cell, in which PDC-disrupted strains are able to grow on glucose and retain C2 prototrophy. A more detailed discussion of gene disruptions is provided below.

In some aspects, the yeast cell comprises one or more (e.g., two, several) heterologous polynucleotides of an active 3-HP pathway described herein (e.g., a heterologous polynucleotide encoding a PPC; a heterologous polynucleotide encoding a PYC; a heterologous polynucleotide encoding an AAT; a heterologous polynucleotide encoding an ADC; a heterologous polynucleotide encoding a BAAT or gabT; and/or a heterologous polynucleotide encoding a 3-HPDH), wherein the yeast cell secretes (and/or is capable of secreting) an increased level of 3-HP compared to the host cell without the one or more heterologous polynucleotides of the active 3-HP pathway when cultivated under the same conditions. In some aspects, the yeast cell secretes and/or is capable of secreting an increased level of 3-HP of at least 5%, e.g., at least 10%, at least 15%, at least 20%, at least 25%, at least 50%, at least 100%, at least 150%, at least 200%, at least 300%, or at least 500% compared to the host cell without the one or more heterologous polynucleotides of the active 3-HP pathway, when cultivated under the same conditions. Examples of suitable cultivation conditions are described below and will be readily apparent to one of skill in the art in view of the teachings herein.

In any of these aspects, the recombinant yeast cell produces (and/or is capable of producing) 3-HP at a yield of at least 10%, e.g., at least 20%, at least 30%, at least 40%, at least 50%, at least 60%, at least 65%, at least 70%, at least 75%, at least 80%, or at least 90%, of theoretical.

In any of these aspects, the recombinant yeast cell has a 3-HP volumetric productivity greater than about 0.1 g/L per hour, e.g., greater than about 0.2 g/L per hour, 0.5 g/L per hour, 0.6 g/L per hour, 0.7 g/L per hour, 0.8 g/L per hour, 0.9 g/L per hour, 1.0 g/L per hour, 1.1 g/L per hour, 1.2 g/L per hour, 1.3 g/L per hour, 1.5 g/L per hour, 1.75 g/L per hour, 2.0 g/L per hour, 2.25 g/L per hour, 2.5 g/L per hour, or 3.0 g/L per hour; or between about 0.1 g/L per hour and about 2.0 g/L per hour, e.g., between about 0.3 g/L per hour and about 1.7 g/L per hour, about 0.5 g/L per hour and about 1.5 g/L per hour, about 0.7 g/L per hour and about 1.3 g/L per hour, about 0.8 g/L per hour and about 1.2 g/L per hour, or about 0.9 g/L per hour and about 1.1 g/L per hour.

In any of these aspects, the recombinant yeast cell produces (and/or is capable of producing) a greater amount of 3-HP compared to the yeast cell without the heterologous polynucleotide encoding the insect ADC or the ADC of the Class Bivalvia, Branchiopoda, Gastropoda, or Leptocardii when cultivated under the same conditions. In some embodiments, the yeast cell produces (and/or is capable of producing) at least 10% more (e.g., at least 15%, at least 20%, at least 25%, at least 30%, at least 35%, at least 40%, at least 45%, at least 50%, at least 75%, at least 100%, at least 200%, at least 300%, or at 500% more) 3-HP compared to the cell without the heterologous polynucleotide encoding the insect ADC or the ADC of the Class Bivalvia, Branchiopoda, Gastropoda, or Leptocardii, when cultivated under the same conditions.

In any of these aspects, the recombinant yeast cell encoding the insect ADC or the ADC of the Class Bivalvia, Branchiopoda, Gastropoda, or Leptocardii produces (and/or is capable of producing) a greater amount of 3-HP compared to a second recombinant yeast cell, when cultivated under the same conditions; wherein the second yeast cell is identical to the yeast cell encoding the insect ADC or the ADC of the Class Bivalvia, Branchiopoda, Gastropoda, or Leptocardii with the proviso that the second yeast cell encodes the *Bacillus licheniformis* ADC of SEQ ID NO: 139 in place of the insect ADC or the ADC of the Class Bivalvia, Branchiopoda, Gastropoda, or Leptocardii. In some embodiments, the yeast cell produces (and/or is capable of producing) at least 10% more (e.g., at least 15%, at least 20%, at least 25%, at least 30%, at least 35%, at least 40%, at least 45%, at least 50%, at least 75%, at least 100%, at least 200%, at least 300%, or at least 500% more) 3-HP compared to the second recombinant yeast cell, when cultivated under the same conditions.

The recombinant yeast cells may be cultivated in a nutrient medium suitable for production of one or more polypeptides of the active 3-HP pathway using methods well known in the art. For example, the cell may be cultivated by shake flask cultivation, or small-scale or large-scale fermentation (including continuous, batch, fed-batch, or solid state fermentations) in laboratory or industrial fermentors in a suitable medium and under conditions allowing the desired polypeptide to be expressed and/or isolated. The cultivation takes place in a suitable nutrient medium comprising carbon and nitrogen sources and inorganic salts, as described herein, using procedures known in the art. Suitable media are available from commercial suppliers, may be prepared according to published compositions (e.g., in catalogues of the American Type Culture Collection), or may be prepared from commercially available ingredients.

The recombinant yeast cells described herein also can be subjected to adaptive evolution to further augment 3-HP biosynthesis, including under conditions approaching theoretical maximum growth.

The recombinant yeast cells described herein can further contain lipase or esterase activity, for example, due to expression of a heterologous polynucleotide encoding a lipase or esterase (EC 3.1.1.-). Such cells can be used to produce an ester of 3-HP, such as methyl 3-hydroxypropionate, ethyl 3-hydroxypropionate, propyl 3-hydroxypropionate, butyl 3-hydroxypropionate, or 2-ethylhexyl 3-hydroxypropionate. The cells can further contain esterase activity, for example, due to expression of a heterologous polynucleotide encoding an esterase. Such cells can be used to produce polymerized 3-HP. The cells can further contain alcohol dehydrogenase activity (EC 1.1.1.1), aldehyde dehydrogenase activity (EC 1.2.1.-), or both, for example, due to expression of a heterologous polynucleotide encoding an alcohol dehydrogenase, aldehyde dehydrogenase, or both. Such cells can be used to produce 1,3-propanediol.

The recombinant yeast cells described herein may utilize expression vectors comprising the coding sequence of one or more (e.g., two, several) heterologous 3-HP pathway genes (e.g., the coding sequence of a PPC, PYC, AAT, ADC, BAAT, gabT, and/or 3-HPDH described herein) linked to one or more control sequences that direct expression in a suitable yeast cell under conditions compatible with the control sequence(s). Such expression vectors may be used in any of the yeast cells and methods described herein. The polynucleotides described herein may be manipulated in a variety of ways to provide expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous 3-HP pathway genes may be introduced into a yeast cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

In one aspect, each heterologous polynucleotide is contained on an independent vector. In another aspect, at least two of the heterologous polynucleotides are contained on a single vector. In another aspect, at least three of the heterologous polynucleotides are contained on a single vector. In another aspect, at least four of the heterologous polynucleotides are contained on a single vector. In another aspect, all the heterologous polynucleotides are contained on a single vector. Polynucleotides encoding heteromeric subunits of a protein complex may be contained in a single heterologous polynucleotide on a single vector or alternatively contained in separate heterologous polynucleotides on separate vectors.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the yeast cell, or a transposon, may be used.

The expression vector may contain any suitable promoter sequence that is recognized by a yeast cell for expression of an insect ADC gene or an ADC gene of the Class Bivalvia, Branchiopoda, Gastropoda, or Leptocardii or any 3-HP pathway gene described herein. The promoter sequence contains transcriptional control sequences that mediate the expression of the polypeptide. The promoter may be any polynucleotide that shows transcriptional activity in the yeast cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one aspect, the heterologous polynucleotide encoding the ADC is operably linked to a promoter foreign to the polynucleotide. In another aspect, the heterologous polynucleotide encoding a polypeptide of a 3-HP pathway described herein (e.g., a PPC, PYC, AAT, ADC, BAAT, gabT, or 3-HPDH) is operably linked to a promoter foreign to the polynucleotide. The promoters may be identical to or share a high degree of sequence identity (e.g., at least about 80%, at least about 85%, at least about 90%, at least about 95%, or at least about 99%) with a selected native promoter.

Examples of suitable promoters for directing the transcription of the nucleic acid constructs in a yeast cells, include, but are not limited to, the promoters obtained from the genes for enolase, (e.g., *S. cerevisiae* enolase or *I. orientalis* enolase (ENO1)), galactokinase (e.g., *S. cerevisiae* galactokinase or *I. orientalis* galactokinase (GAL1)), alcohol dehydrogenase/glyceraldehyde-3-phosphate dehydrogenase (e.g., *S. cerevisiae* alcohol dehydrogenase/glyceraldehyde-3-phosphate dehydrogenase or *I. orientalis* alcohol dehydrogenase/glyceraldehyde-3-phosphate dehydrogenase (ADH1, ADH2/GAP)), triose phosphate isomerase (e.g., *S. cerevisiae* triose phosphate isomerase or *I. orientalis* triose phosphate isomerase (TPI)), metallothionein (e.g., *S. cerevisiae* metallothionein or *I. orientalis* metallothionein (CUP1)), 3-phosphoglycerate kinase (e.g., *S. cerevisiae* 3-phosphoglycerate kinase or *I. orientalis* 3-phosphoglycerate kinase (PGK)), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other useful promoters for yeast host cells are described by Romanos et al., 1992, *Yeast* 8: 423-488.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, or at least about 99%) with the selected native terminator. In certain embodiments, 3-HP pathway genes are linked to a terminator that comprises a functional portion of a native GAL10 gene native to the host cell or a sequence that shares at least 80%, at least 85%, at least 90%, or at least 95% sequence identity with a native GAL10 terminator.

Suitable terminators for yeast host cells are obtained from the genes for enolase (e.g., *S. cerevisiae* or *I. orientalis* enolase cytochrome C (e.g., *S. cerevisiae* or *I. orientalis* cytochrome (CYC1)), glyceraldehyde-3-phosphate dehydrogenase (e.g., *S. cerevisiae* or *I. orientalis* glyceraldehyde-3-phosphate dehydrogenase (gpd)), PDC1, XR, XDH, transaldolase (TAL), transketolase (TKL), ribose 5-phosphate ketol-isomerase (RKI), CYB2, and the galactose family of genes (especially the GAL10 terminator). Other useful terminators for yeast host cells are described by Romanos et al., 1992, supra.

The control sequence may also be a suitable leader sequence, when transcribed is a nontranslated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for enolase (e.g., *S. cerevisiae* or *I. orientalis* enolase (ENO-1)), 3-phosphoglycerate kinase (e.g., *S. cerevisiae* or *I. orientalis* 3-phosphoglycerate kinase), alpha-factor (e.g., *S. cerevisiae* or *I. orientalis* alpha-factor), and alcohol dehydrogenase/glyceraldehyde-3-phosphate dehydrogenase (e.g., *S. cerevisiae* or *I. orientalis* alcohol dehydrogenase/glyceraldehyde-3-phosphate dehydrogenase (ADH2/GAP)).

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, *Mol. Cellular Biol.* 15: 5983-5990.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked with the regulatory sequence.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like. Suitable markers for yeast host cells include ADE2, HIS3, LEU2, LYS2, MET3, TRP1, and URA3.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo. Examples of origins of replication for use in a yeast host cell are the 2 micron origin of replication, ARS1, ARS4, the combination of ARS1 and CEN3, and the combination of ARS4 and CEN6.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, supra).

Additional procedures and techniques known in the art for the preparation of yeast cells comprising one or more 3-HP pathway genes, are described in, e.g., WO 2012/074818, the content of which is hereby incorporated by reference.

Gene Disruptions

The recombinant yeast cell may also comprise one or more (e.g., two, several) gene disruptions, e.g., to divert sugar metabolism from undesired products to 3-HP. In some aspects, the recombinant host cells produce a greater amount of 3-HP compared to the cell without the one or more disruptions when cultivated under identical conditions. In some aspects, one or more of the disrupted endogenous genes are inactivated.

In certain embodiments, the recombinant yeast cells provided herein comprise a disruption of one or more endogenous genes encoding enzymes involved in ethanol fermentation, including for example pyruvate decarboxylase (PDC, converts pyruvate to acetaldehyde) and/or alcohol dehydrogenase (ADH, converts acetaldehyde to ethanol) genes. These modifications decrease the ability of the yeast cell to produce ethanol, thereby maximizing 3-HP production. However, in certain embodiments the recombinant yeast cells provided herein may be engineered to co-produce 3-HP and ethanol. In those embodiments, endogenous genes encoding an enzyme involved in ethanol fermentation are preferably not disrupted, and in certain embodiments the yeast cells may comprise one or more heterologous genes that increase ethanol production.

In some embodiments, the recombinant yeast cells comprise a disruption to an endogenous gene encoding a PDC having at least 75%, e.g., at least 80%, at least 85%, at least 90%, at least 95%, at least 96%, at least 97%, at least 98%, at least 99%, or 100% sequence identity to SEQ ID NO: 154. In some embodiments, the endogenous gene encodes a PDC having an amino acid sequence comprising or consisting of SEQ ID NO: 154. In some embodiments, the coding sequence of the endogenous gene encoding the PDC has at least 75%, e.g., at least 80%, at least 85%, at least 90%, at least 95%, at least 96%, at least 97%, at least 98%, at least 99%, or 100% sequence identity to SEQ ID NO: 153. In some embodiments, the coding sequence of the endogenous gene encoding the PDC comprises or consists of SEQ ID NO: 153. In some embodiments, the endogenous gene encoding the PDC is inactivated.

In certain embodiments, the recombinant yeast cells provided herein comprise a disruption of one or more endogenous genes encoding enzymes involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), aldehyde dehydrogenase (ALD, e.g., converts acetaldehyde to acetate or 3-HP to 3-HPA), and butanediol dehydrogenase (catalyzes conversion of butanediol to acetoin and vice versa) genes.

In some embodiments, the recombinant yeast cells comprise a disruption to an endogenous gene encoding a GPD having at least 75%, e.g., at least 80%, at least 85%, at least 90%, at least 95%, at least 96%, at least 97%, at least 98%, at least 99%, or 100% sequence identity to SEQ ID NO: 156. In some embodiments, the endogenous gene encodes a GPD having an amino acid sequence comprising or consisting of SEQ ID NO: 156. In some embodiments, the coding sequence of the endogenous gene encoding the GPD has at least 75%, e.g., at least 80%, at least 85%, at least 90%, at least 95%, at least 96%, at least 97%, at least 98%, at least 99%, or 100% sequence identity to SEQ ID NO: 155. In some embodiments, the coding sequence of the endogenous gene encoding the GPD comprises or consists of SEQ ID NO: 155. In some embodiments, the endogenous gene encoding the GPD is inactivated.

In certain embodiments, the recombinant yeast cells provided herein comprise a disruption of one or more endogenous genes encoding enzymes that catalyze a reverse reaction in a 3-HP pathway, including for example PEP carboxykinase (PCK), enzymes with OAA decarboxylase activity, or CYB2A or CYB2B (catalyzes the conversion of lactate to pyruvate). PCK catalyzes the conversion of PEP to OAA and vice versa, but exhibits a preference for the OAA to PEP reaction. To reduce the conversion of OAA to PEP, one or more copies of a native PCK gene may be disrupted. In certain embodiments, yeast cells in which one or more native PCK genes have been disrupted may express one or more heterologous PCK genes that have been mutated to encode a polypeptide favoring the conversion of PEP to OAA. OAA decarboxylase catalyzes the conversion of OAA to pyruvate. Enzymes with OAA decarboxylase activity have been identified, such as that coded by the Entner-Doudoroff aldolase (eda) gene in *E. coli* and malic enzyme (MAE) in yeast and fungi. To reduce OAA decarboxylase activity, one or more copies of a native gene encoding an enzyme with OAA decarboxylase activity may be disrupted. In certain embodiments, yeast cells in which one or more native OAA decarboxylation genes have been disrupted may express one or more heterologous OAA decarboxylation genes that have been mutated to encode a polypeptide that catalyzes the conversion of pyruvate to OAA.

In certain embodiments, the recombinant yeast cells provided herein comprise a disruption of one or more endogenous genes encoding enzymes involved in an undesirable reaction with a 3-HP pathway product or intermediate. Examples of such genes include those encoding an enzyme that converts 3-HP to an aldehyde of 3-HP, which are known to be toxic to certain cells.

In certain embodiments, the recombinant yeast cells provided herein comprise a disruption of one or more endogenous genes encoding enzymes that have a neutral effect on a 3-HP pathway, including for example GALE (negative regulator of the GAL system that converts galactose to glucose). Disruption of neutral genes allows for insertion of one or more heterologous genes without affecting native pathways.

Modeling can also be used to design gene disruptions that additionally optimize utilization of the pathway (see, for example, U.S. 2002/0012939, U.S. 2003/0224363, U.S. 2004/0029149, U.S. 2004/0072723, U.S. 2003/0059792, U.S. 2002/0168654, U.S. 2004/0009466, and U.S. Pat. No. 7,127,379). Modeling analysis allows reliable predictions of the effects on cell growth of shifting the metabolism towards more efficient production of 3-HP. One exemplary computational method for identifying and designing metabolic alterations favoring biosynthesis of a desired product is the OptKnock computational framework, Burgard et al., 2003, *Biotechnol. Bioeng.* 84: 647-657.

The recombinant yeast cells comprising a gene disruption may be constructed using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The recombinant yeast cells comprising a gene disruption may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The recombinant yeast cells comprising a gene disruption may also be constructed by introducing, substituting, and/or removing one or more (several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, 1985, *Science* 229: 4719; Lo et al., 1985, *Proc. Natl. Acad. Sci. U.S.A.* 81: 2285; Higuchi et al., 1988, *Nucleic Acids Res* 16: 7351; Shimada, 1996, *Meth. Mol. Biol.* 57: 157; Ho et al., 1989, *Gene* 77: 61; Horton et al., 1989, *Gene* 77: 61; and Sarkar and Sommer, 1990, *Bio Techniques* 8: 404.

The recombinant yeast cells comprising a gene disruption may also be constructed by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The recombinant yeast cells comprising a gene disruption may also be constructed by the process of gene conversion (see, for example, Iglesias and Trautner, 1983, *Molecular General Genetics* 189: 73-76). For example, in the gene conversion method, a nucleotide sequence corresponding to the gene is mutagenized in vitro to produce a defective nucleotide sequence, which is then transformed into the recombinant strain to produce a defective gene. By homologous recombination, the defective nucleotide sequence replaces the endogenous gene. It may be desirable that the defective nucleotide sequence also comprises a marker for selection of transformants containing the defective gene.

The recombinant yeast cells comprising a gene disruption may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a recombinant strain of choice.

In another aspect, the modification of a gene in the recombinant yeast cell is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Methods of Producing 3-HP and Related Compounds

The recombinant yeast cells described herein may be used for the production of 3-HP. In another aspect is a method of producing 3-HP, comprising: (a) cultivating any one of the recombinant yeast cells described herein (e.g., a recombinant host cell comprising a heterologous polynucleotide encoding an insect ADC) in a medium under suitable conditions to produce the 3-HP; and (b) recovering the 3-HP.

The recombinant yeast cells comprising an active 3-HP pathway may be cultivated in a nutrient medium suitable for 3-HP production using methods well known in the art. For example, the cells may be cultivated by shake flask cultivation, or small-scale or large-scale fermentation (including continuous, batch, fed-batch, or solid state fermentations) in laboratory or industrial fermentors performed in a suitable fermentation medium and under conditions allowing 3-HP production.

The recombinant yeast cells may produce 3-HP in a fermentable medium comprising one or more (e.g., two, several) sugars, such as glucose, fructose, sucrose, cellobiose, xylose, xylulose, arabinose, mannose, galactose, and/or soluble oligosaccharides. The carbon source may be a twelve carbon sugar such as sucrose, a hexose sugar such as glucose or fructose, glycan or other polymer of glucose, glucose oligomers such as maltose, maltotriose and isomaltotriose, panose, and fructose oligomers. If the cell is modified to impart an ability to ferment pentose sugars, the fermentation medium may include a pentose sugar such as xylose, xylan or other oligomer of xylose, and/or arabinose. Such pentose sugars are suitably hydrolysates of a hemicellulose-containing biomass. In some embodiments, the cell is unable to ferment pentose sugars and/or the fermentable medium comprises less than 1% pentose sugars. In some instances, the fermentable medium is derived from a natural source, such as sugar cane, starch, or cellulose, and may be the result of pretreating the source by enzymatic hydrolysis (saccharification). In some aspects, the fermentable medium comprises sugar cane juice. Suitable media are available from commercial suppliers, may be prepared according to published compositions (e.g., in catalogues of the American Type Culture Collection), or may be prepared from commercially available ingredients.

In addition to the appropriate carbon sources from one or more (e.g., two, several) sugar(s), the fermentable medium may contain other nutrients or stimulators known to those skilled in the art, such as macronutrients (e.g., nitrogen sources) and micronutrients (e.g., vitamins, mineral salts, and metallic cofactors). In some aspects, the carbon source can be preferentially supplied with at least one nitrogen source, such as yeast extract, $N_2$, peptone (e.g., Bacto™ Peptone), or soytone (e.g., Bacto™ Soytone). Non-limiting examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. Examples of mineral salts and metallic cofactors include, but are not limited to, Na, P, K, Mg, S, Ca, Fe, Zn, Mn, Co, and Cu.

In some embodiments, the recombinant yeast cells of the invention can be cultured in a chemically defined medium. In one example, the medium contains around 5 g/L ammonium sulfate, around 3 g/L potassium dihydrogen phosphate, around 0.5 g/L magnesium sulfate, trace elements, and vitamins and around 150 g/L glucose. The pH may be allowed to range freely during cultivation, or may be buffered if necessary to prevent the pH from falling below or rising above predetermined levels. In certain embodiments, the fermentation medium is inoculated with sufficient yeast cells that are the subject of the evaluation to produce an $OD_{600}$ of about 1.0. Unless explicitly noted otherwise, $OD_{600}$ as used herein refers to an optical density measured at a wavelength of 600 nm with a 1 cm path length using a Model DU600 spectrophotometer (Beckman Coulter).

Specific conditions used for the methods of 3-HP production may be determined by one skilled in the art in light of the teachings herein. In some aspects of the methods, the yeast cells are cultivated for about 12 hours to about 216 hours, such as about 24 hours to about 144 hours, or about 36 hours to about 96 hours. The temperature is typically between about 26° C. to about 60° C., e.g., about 34° C. to about 50° C.

Cultivation may be performed under anaerobic, substantially anaerobic (microaerobic), or aerobic conditions, as appropriate. Briefly, anaerobic refers to an environment devoid of oxygen, substantially anaerobic (microaerobic) refers to an environment in which the concentration of oxygen is less than air, and aerobic refers to an environment wherein the oxygen concentration is approximately equal to or greater than that of the air. Substantially anaerobic conditions include, for example, a culture, batch fermentation or continuous fermentation such that the dissolved oxygen concentration in the medium remains less than 10% of saturation. Substantially anaerobic conditions also includes growing or resting cells in liquid medium or on solid agar inside a sealed chamber maintained with an atmosphere of less than 1% oxygen. The percent of oxygen can be maintained by, for example, sparging the culture with a $N_2/CO_2$ mixture or other suitable non-oxygen gas or gases. In some embodiments, the cultivation is performed under anaerobic conditions or substantially anaerobic conditions.

In one example, the concentration of cells in the fermentation medium is typically in the range of about 0.1 to 20, preferably from 0.1 to 5, even more preferably from 1 to 3 g dry cells/liter of fermentation medium during the production phase. If desired, oxygen uptake rate (OUR) can be varied throughout fermentation as a process control (see, e.g., WO 03/102200). In some embodiments, the recombinant yeast cells provided herein are cultivated under microaerobic conditions characterized by an oxygen uptake rate from 2 to 45 mmol/L/hr, e.g., 2 to 25, 2 to 20, 2 to 15, 2 to 10, 10 to 45, 15 to 40, 20 to 35, or 25 to 35 mmol/L/hr. In certain embodiments, the recombinant yeast cells provided herein may perform especially well when cultivated under microaerobic conditions characterized by an oxygen uptake rate of from 2 to 25 mmol/L/hr. The medium may be buffered during the production phase such that the pH is maintained in a range of about 3.0 to about 7.0, or from about 4.0 to about 6.0. Suitable buffering agents are basic materials that neutralize the acid as it is formed, and include, for example, calcium hydroxide, calcium carbonate, sodium hydroxide, potassium hydroxide, potassium carbonate, sodium carbonate, ammonium carbonate, ammonia, ammonium hydroxide and the like. In general, buffering agents that have been used in conventional fermentation processes are also suitable here.

In those embodiments where a buffered fermentation is utilized, acidic fermentation products may be neutralized to the corresponding salt as they are formed. In these embodiments, recovery of the acid involves regeneration of the free acid. This may be done by removing the cells and acidulating the fermentation broth with a strong acid such as sulfuric acid. This results in the formation of a salt by-product. For example, where a calcium salt is utilized as the neutralizing agent and sulfuric acid is utilized as the acidulating agent, gypsum is produced as a salt by-product. This by-product is separated from the broth, and the acid is recovered using techniques such as liquid-liquid extraction, distillation, absorption, and others (see, e.g., T. B. Vickroy, Vol. 3, Chapter 38 of *Comprehensive Biotechnology*, (ed. M. Moo-Young), Pergamon, Oxford, 1985; Datta et al., 1995, *FEMS Microbiol. Rev.* 16: 221-231; U.S. Pat. Nos. 4,275,234, 4,771,001, 5,132,456, 5,420,304, 5,510,526, 5,641,406, and 5,831,122, and WO 93/00440.

In other embodiments, the pH of the fermentation medium may be permitted to drop during cultivation from a starting pH that is at or above the pKa of 3-HP, typically 4.5 or higher, to at or below the pKa of the acid fermentation product, e.g., less than 4.5 or 4.0, such as in the range of about 1.5 to about 4.5, in the range of from about 2.0 to about 4.0, or in the range from about 2.0 to about 3.5.

In still other embodiments, the fermentation may be carried out to produce a product acid by adjusting the pH of the fermentation broth to at or below the pKa of the product acid prior to or at the start of the fermentation process. The pH may thereafter be maintained at or below the pKa of the product acid throughout the cultivation. In certain embodiments, the pH may be maintained at less than 4.5 or 4.0, such as in a range of about 1.5 to about 4.5, in a range of about 2.0 to about 4.0, or in a range of about 2.0 to about 3.5.

The methods described herein can employ any suitable fermentation operation mode. For example, batch mode fermentation may be used with a close system where culture medium and recombinant yeast, set at the beginning of fermentation, have no additional input except for certain reagents, e.g., for pH control, foam control or others required for process sustenance. The process described herein can also be employed in fed-batch or continuous mode, as mentioned supra.

The methods described herein may be practiced in several bioreactor configurations, such as stirred tank, bubble column, airlift reactor and others known to those skilled in the art. The methods may be performed in free cell culture or in immobilized cell culture as appropriate. Any material support for immobilized cell culture may be used, such as alginates, fibrous bed, or argyle materials such as chrysotile, montmorillonite KSF, and montmorillonite K-10.

In another aspect of the methods, the 3-HP is produced at a titer greater than about 5 g/L, e.g., greater than about 10 g/L, 25 g/L, 50 g/L, 75 g/L, 100 g/L, 125 g/L, 150 g/L, 160 g/L, 170 g/L, 180 g/L, 190 g/L, 200 g/L, 210 g/L, 225 g/L, 250 g/L, 275 g/L, 300 g/L, 325 g/L, 350 g/L, 400 g/L, or 500 g/L; or between about 10 g/L and about 500 g/L, e.g., between about 50 g/L and about 350 g/L, about 100 g/L and about 300 g/L, about 150 g/L and about 250 g/L, about 175 g/L and about 225 g/L, or about 190 g/L and about 210 g/L. In one embodiment, the 3-HP is produced at a titer greater than about 0.01 gram per gram of carbohydrate, e.g., greater than about 0.02, 0.05, 0.75, 0.1, 0.2, 0.3, 0.4, 0.5, 0.6, 0.7, 0.8, 0.9, or 1.0 gram per gram of carbohydrate.

In another aspect of the methods, the amount of produced 3-HP is at least 5%, e.g., at least 10%, at least 15%, at least 20%, at least 25%, at least 30%, at least 50%, or at least 100% greater compared to cultivating the recombinant yeast cell without the heterologous polynucleotide encoding the insect ADC or the ADC of the Class Bivalvia, Branchiopoda, Gastropoda, or Leptocardii when cultivated under the same conditions.

In certain embodiments of the methods provided herein, the recombinant yeast cells produce relatively low levels of ethanol. In certain embodiments, ethanol may be produced in a yield of 10% or less, preferably in a yield of 2% or less. In certain of these embodiments, ethanol is not detectably produced. In other embodiments, however, 3-HP and ethanol may be co-produced. In these embodiments, ethanol may be produced at a yield of greater than 10%, greater than 25%, or greater than 50%.

The 3-HP can be optionally recovered from the fermentation medium using any procedure known in the art including, but not limited to, chromatography (e.g., size exclusion chromatography, adsorption chromatography, ion exchange chromatography), electrophoretic procedures, differential solubility, osmosis, distillation, extraction (e.g., liquid-liquid extraction), pervaporation, extractive filtration, membrane filtration, membrane separation, reverse, or ultrafiltration. In one aspect, the 3-HP is separated from other fermented material and purified by conventional methods of distillation. Accordingly, in another aspect, the method further comprises purifying the recovered 3-HP by distillation.

The recombinant 3-HP may also be purified by the chemical conversion of impurities (contaminants) to products more easily removed from 3-HP by the procedures described above (e.g., chromatography, electrophoretic procedures, differential solubility, distillation, or extraction) and/or by direct chemical conversion of impurities to 3-HP. For example, in another aspect, the method further comprises purifying the recovered 3-HP by converting β-alanine contaminant to 3-HP, using chemical techniques known in the art.

In some aspects of the methods, the recombinant 3-HP preparation before and/or after being optionally purified is substantially pure. With respect to the methods of producing 3-HP, "substantially pure" means a recovered preparation that contains no more than 15% impurity, wherein impurity means compounds other than 3-HP. In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

It is understood that a 3-HP pathway passing through a β-alanine intermediate can be applied for β-alanine production (e.g., if a downstream gene converting β-alanine to malonate semialdehyde is disrupted; see FIG. 1). In this case, the recombinant yeast cell would produce β-alanine instead of 3-HP or a mixture of β-alanine and 3-HP. It is further understood that, if desired, β-alanine produced by a recombinant yeast cell described herein can be chemically converted to 3-HP by methods known in the art, as mentioned supra.

3-HP produced using the methods disclosed herein can be chemically converted into other organic compounds. For example, 3-HP can be hydrogenated to form 1,3-propanediol, a valuable polyester monomer. Propanediol also can be created from 3-HP using polypeptides having oxidoreductase activity in vitro or in vivo. Hydrogenating an organic acid such as 3-HP can be performed using any method such as those used to hydrogenate succinic acid and/or lactic acid. For example, 3-HP can be hydrogenated using a metal catalyst.

The 3-HP produced by any of the methods described herein may be converted to acrylic acid. Acrylic acid can be produced by the chemical dehydration of 3-HP using techniques known in the art, e.g., heating in the presence of a catalyst (e.g., a solid oxide dehydration catalyst such as titania or alumina).

In another aspect is a method of producing acrylic acid or a salt thereof, comprising: (a) cultivating a recombinant yeast cell described herein (e.g., a recombinant host cell comprising a heterologous polynucleotide encoding an insect ADC) in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

Suitable assays to test for the production of 3-HP and acrylic acid for the methods of production and yeast cells described herein can be performed using methods known in the art. For example, final 3-HP product and intermediates (e.g., β-alanine), as well as other organic compounds, can be analyzed by methods such as HPLC (High Performance Liquid Chromatography), GC-MS (Gas Chromatography Mass Spectroscopy), and LC-MS (Liquid Chromatography-Mass Spectroscopy), or other suitable analytical methods using routine procedures well known in the art. The release of 3-HP in the fermentation broth can also be tested with the culture supernatant. Byproducts and residual sugar in the fermentation medium (e.g., glucose) can be quantified by HPLC using, for example, a refractive index detector for glucose and alcohols, and a UV detector for organic acids (Lin et al., 2005, *Biotechnol. Bioeng.* 90: 775-779), or using other suitable assay and detection methods well known in the art.

The following examples are provided by way of illustration and are not intended to be limiting of the invention.

EXAMPLES

Chemicals used as buffers and substrates were commercial products of at least reagent grade.

Strains

*I. orientalis* CNB1 yeast strains were constructed from *I. orientalis* CD1822 as described in WO 2012/074818, the content of which is incorporated herein by reference.

Media and Solutions

CNB1 shake flask media was composed of 2.3 g of urea, 0.5 g of magnesium sulfate heptahydrate, 3.0 g of potassium phosphate monobasic, 1 ml of trace elements solution, 1 ml of vitamin solution, 120 g of glucose, 97.6 g of 2-(N-morpholino)ethanesulfonic acid (MES), and deionized water to 1 liter. After dissolving all medium components, the pH of the medium was adjusted to an initial pH of 5.8 using an appropriate base (e.g., KOH) and filter sterilized.

DM2 medium was composed of a N source (5.0 g of ammonium sulfate or 2.3 g of urea), 0.5 g of magnesium sulfate heptahydrate, 3.0 g of potassium phosphate monobasic, 1 ml of trace elements solution, 1 ml of vitamin solution, 50-120 g of glucose, and deionized water to 1 liter. After dissolving all medium components, the pH of the medium was adjusted to the desired initial pH using an appropriate acid or base (e.g., HCl or KOH) and then sterilized by filtration.

LiOAc/TE solution was composed of 8 parts sterile water, 1 part 1 M LiOAc, and 1 part 10×TE.

2× Noble agar plate medium was composed of 10 g of Difco Agar Noble (Becton, Dickinson and Company) and 250 ml of deionized water, and then sterilized by autoclaving.

PEG/LiOAc/TE Solution was composed of 8 parts 50% PEG3350, 1 part 1 M LiOAc, and 1 part 10×TE.

50% PEG3350 was prepared by adding 100 g of PEG3350 to 150 mL of water and heating and stirring until dissolved. The volume was then brought up to 200 mL with water and then sterilized by autoclaving.

2×SD ura– medium was composed of 6.66 g of yeast nitrogen base without amino acids, 1.54 g of ura– DO supplement (Clontech Laboratories, Inc.), 20 g of dextrose, and deionized water to 1 liter. The resulting solution was filter sterilized.

SD ura− plates were prepared by mixing of 250 mL of 2×-Ura selection medium and 2× Noble agar plate medium (cooled to 65° C. after autoclaving) and then pouring the molten medium into Petri dishes and allowing to cool to room temperature.

TAE buffer was composed of 4.84 g of Tris base, 1.14 mL of glacial acetic acid, and 2 mL of 0.5 M EDTA pH 8.0, and deionized water to 1 liter.

TBE buffer was composed of 10.8 g of Tris base, 5.5 g of boric acid, 4 mL of 0.5 M EDTA pH 8.0, and deionized water to 1 liter.

10×TE (200 mL) was composed of 2.42 g of Tris Base and 4 mL of 0.5 M EDTA, pH 8.0. 5 M HCl was used to adjust the pH to 7.5 and the solution was sterilized by autoclaving.

Trace elements solution was composed of 15.0 g of EDTA, 4.5 g of zinc sulfate heptahydrate, 1.0 g of manganese chloride dehydrate, 0.3 g of cobalt(II) chloride hexahydrate, 0.3 g of copper(II) sulfate pentahydrate, 0.4 g of disodium molybdenum dehydrate, 4.5 g of calcium chloride dehydrate, 3 g of iron sulphate heptahydrate, 1.0 g of boric acid, 0.1 g of potassium iodide, and deionized water to 1 liter. The solution was filter sterilized.

Vitamin solution was composed of 14.4 g of D-biotin, 1 g of calcium pantothenate, 5 g of nicotinic acid, 25 g of myo-inositol, 1 g of pyridoxine hydrochloride, 0.2 g of p-aminobenzoic acid, 1 g of thiamine hydrochloride, and deionized water to 1 liter. The solution was filter sterilized.

YP+10% glucose medium was composed of 500 mL of YP broth and 100 mL of sterile 50% glucose.

YP broth was composed of 10 g of yeast extract, 20 g of peptone, and deionized water to 1 liter. The solution was sterilized by autoclaving.

2×YT+amp plates were composed of 16 g of tryptone, 10 g of yeast extract, 5 g of NaCl, and 15 g of Bacto agar, and deionized water to 1 liter. Following autoclave sterilization, 100 mg of ampicillin were added per liter and plates poured.

TABLE 4

Primers sequences used in the Examples.

| Identifier | SEQ ID NO: | Sequence (5'-3') |
|---|---|---|
| 0611245 | 196 | CGAACCAATTCAAGAAAACCAAC |
| 0611317 | 197 | GGTCCTTACATCTGTCTAGT |
| 0611631 | 198 | TGTATACAGGATCGAAGAATAGAAG |
| 0611632 | 199 | GAACGTCTACAACGAGGTGAAC |
| 0612908 | 216 | GGTCCTTACATCTGTCTAGT |
| 0615362 | 205 | GAGATATTGATCCTTCTCC |
| 0615988 | 217 | ACAGCGGACGAAGATCCTTC |
| 0615989 | 218 | CCTGGTCAAGTATTGCCAACAG |

TABLE 4-continued

Primers sequences used in the Examples.

| Identifier | SEQ ID NO: | Sequence (5'-3') |
|---|---|---|
| 1204010 | 200 | CGTTGTAAAACGACGGCCAGTGAATTCGTTAACCATTTTGCACAAGTAGTAGCCAGTCATCC |
| 1204011 | 201 | CTGACAGGAACCGATGGACTCGCGGCCGCTTTTTCTAATAGGGGGAGGGGGG |
| 1204012 | 202 | AATAATATATAATTTTATAATAAAAGCGGCCGCGAGTGTATACCTCCCCGCTTTTGCTGCTAC |
| 1204013 | 203 | CAGCTATGACCATGATTACGCCAAGCTCCGCGGGGACGAAAAAAATGAATAGGAAAGTTTTTCTCGGAAGGCAAAGCCG |
| 1204049 | 204 | GCTCACATACAAGAAACGGTTCAG |
| 1204065 | 206 | CTCCTCCATCAAGTCCCGTG |
| 1204050 | 207 | CTCCGTGAATATCCTCAGTGCTG |
| 1204060 | 208 | GAATGTACCAACGTCTGCTTCTG |
| 1204061 | 209 | GGTGTTACCCTTGGAGCAGAAC |
| 0613109 | 227 | GTTTGTAATCCTATTCTCAGGAGC |
| 1206368 | 228 | GAGAGGGAAGTGTCATGCGTAGCATACTC |
| 1206369 | 229 | CATTAGGCAAATAAAGGAGCGATGATCTTTATCTTGG |

Example 1: Procedure for Transformation of DNA into the Yeast Genome

DNA transformation into the yeast host genome to generate the recombinant yeast strains described in the following Examples was performed based on the specific procedure below.

Three mL of YP+10% glucose medium were added to a 14 mL Falcon tube and the desired strain was inoculated into this medium using a sterile loop. The culture was grown overnight (approximately 16 hours) at 37° C. with shaking at 250 rpm. A 0.5 mL volume of the overnight culture was added to a 125 mL baffled flask containing 25 mL of liquid YP+10% glucose medium. The flask was incubated at 37° C. with shaking at 250 rpm. Small aliquots of the culture were withdrawn at approximately hourly intervals and the $OD_{600}$ was measured. The culture was grown until the $OD_{600}$ was 0.6-1.0.

The cells were harvested by centrifugation at 2279×g at room temperature. The pellet was resuspended in 25 mL of sterile water, and then centrifuged at 2279×g at room temperature. The pellet was resuspended in 1 mL sterile water, and the resuspended cells were transferred to a 1.5 mL tube and then pelleted at 16,100×g. The cells were resuspended in 1 mL of LiOAc/TE solution and then pelleted at 16,100× g. The cell pellet was then resuspended in 250 μL of LiOAc/TE solution.

The following components were added to a 1.5 mL tube: 100 μL of the above cells, 10 μL of freshly boiled then iced salmon sperm DNA (Agilent Technologies, Inc.), and 10 μL of the desired, linearized transforming DNA. A control reaction with water instead of DNA was also prepared. To each transformation reaction, 600 μL of PEG/LiOAc/TE Solution were added followed by 40 μL of DMSO and the reactions were inverted several times to mix. The transformation reactions were incubated in a 42° C. water bath for 15 minutes, and cells were pelleted at 5,400×g for 1 minute. Cells were resuspended in water, split in two, and each half of the transformation reaction was spread onto SD ura– plates. The plates were incubated at 37° C. Colonies were visible after 2 days of growth.

Example 2: Construction of Yeast Strains Expressing a Heterologous Insect Aspartate 1-Decarboxylase at the Adh2556 Locus This Example describes the construction of yeast cells containing four copies of polynucleotides encoding the *Aedes aegypti* ADC of SEQ ID NO: 162 at the adh2556 locus with two copies under control of the *I. orientalis* PDC promoter and two copies under the control of the *I. orientalis* TDH3 promoter. A left-hand construct and a right-hand construct were designed to allow homologous recombination at the *I. orientalis* CNB1 adh2556 locus. To prevent recombination from occurring between the multiple copies of the nucleotide sequences encoding the same ADC sequence, four distinct nucleotide sequences codon-optimized for expression in *I. orientalis* were designed to encode the same ADC sequence. Additionally, since the initial set of constructs was designed to target the gal6 locus of *I. orientalis*, the adh2556 targeting sequences were incorporated into these vectors.

Construction of a Left-Hand Fragment

Figure 3:
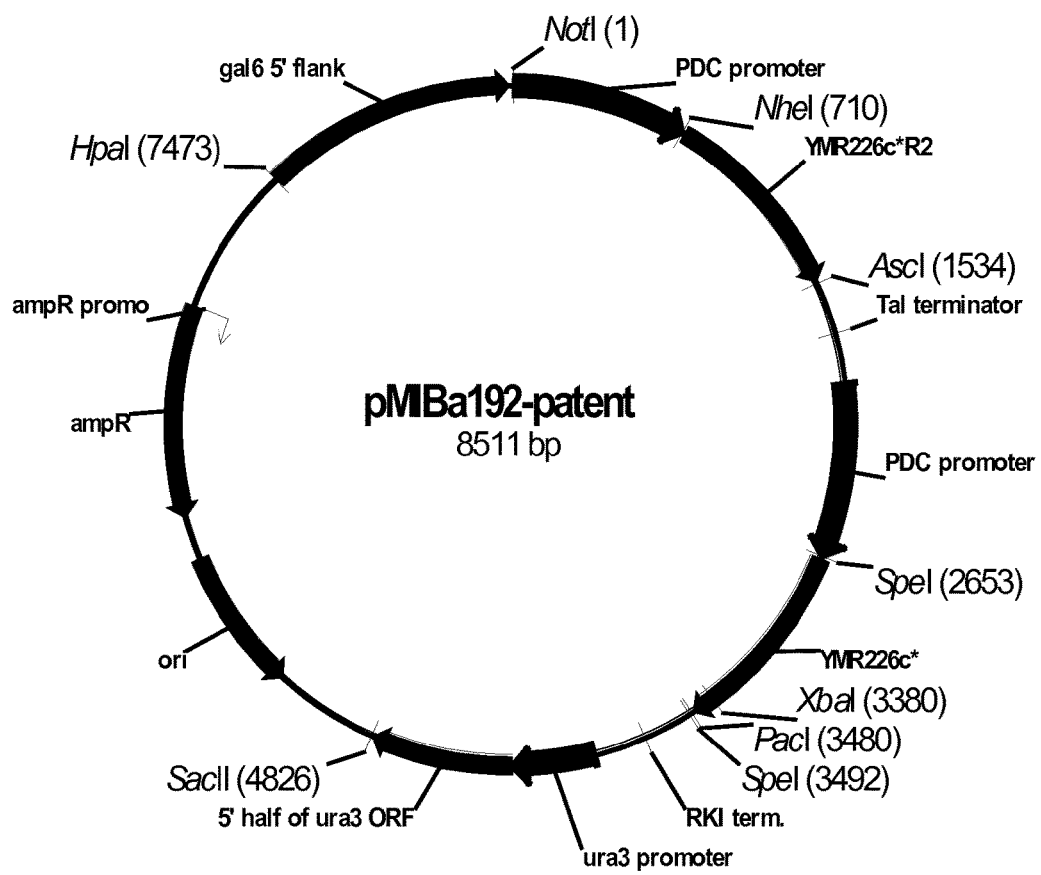
FIG. 3 shows a plasmid map for pMIBa192.

The first cloning step for the left-hand construct was to replace the gal6 5' homology region present in pMIBa192 (FIG. 3) with the adh2556 5' homology region. A PCR product containing the sequence 5' of the adh2556 ORF, along with desired additional restriction sites and flanking DNA for cloning, was amplified with primers 1204010 and 1204011. The amplification reaction was performed using Platinum® pfx DNA polymerase (Invitrogen Corp.) according to manufacturer's instructions. The PCR was composed of 3 μl of an *I. orientalis* MBin500 genomic preparation (WO 2012/074818), 25 pM primer 1204010, 25 pM primer 1204011, 1×pfx amplification buffer (Invitrogen Corp.), 2 mM MgSO$_4$, and 1.25 units of Platinum® pfx DNA polymerase in a final volume of 50 μl. The reaction was incubated in an EPPENDORF® MASTERCYCLER® (Eppendorf Scientific Inc.) programmed for 1 cycle at 95° C. for 2 minutes; 25 cycles each at 95° C. for 1 minute, 55° C. for 1 minute, and 72° C. for 1 minute; and 1 cycle at 72° C. for 3 minutes. Following thermocycling, the PCR products were separated by 1% agarose gel electrophoresis in TBE buffer where an approximately 950 bp PCR product was excised from the gel and purified using a QIAQUICK® Gel Extraction Kit (QIAGEN Inc.) according to the manufacturer's instructions.

To create a recipient vector for the above PCR product, plasmid pMIBa192 (FIG. 3) was digested with HpaI and NotI-HF at 37° C. for 1 hour, and purified by 1% agarose gel electrophoresis in TBE buffer where an approximately 7.4 kbp band was excised from the gel and purified using a QIAQUICK® Gel Extraction Kit according to the manufacturer's instructions. The PCR product and the 7.4 kbp HpaI/NotI pMIBa192 fragment were joined together using an IN-FUSION™ Advantage PCR Cloning Kit (Clontech Laboratories, Inc.) in a total reaction volume of 10 μL composed of 105 ng of the HpaI/NotI pMIBa192 fragment, 33 ng of the adh2556 5' homology containing PCR product, 1× IN-FUSION™ reaction buffer (Clontech Laboratories, Inc.), and 1 μL of IN-FUSION™ enzyme (Clontech Laboratories, Inc.). The reaction was incubated at 50° C. for 15 minutes, and then placed on ice. The reaction was used to transform ONE SHOT® TOP10 chemically competent *E. coli* cells (Invitrogen Corp.) according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 (QIAGEN Inc.) and screened for proper insertion of the desired PCR products by digestion with SmaI and NheI. A plasmid yielding the desired band sizes was confirmed to be correct by DNA sequencing and designated plasmid pMeJi359.

Plasmid pMeJi359 is a left-hand *I. orientalis* adh2556 targeting construct containing the PDC promoter driving expression of an *I. orientalis* ymr226c variant gene codon-optimized for expression in *I. orientalis* (YMR226c*), the *I. orientalis* TAL terminator, the *I. orientalis* PDC promoter driving expression of a second *I. orientalis* ymr226c variant gene codon-optimized for expression in *I. orientalis* (YMR226c*r2), the *I. orientalis* RKI terminator, the *I. orientalis* URA3 promoter, and the 5' fragment of the *I. orientalis* URA3 ORF.

The first *I. orientalis* yrm226c variant ORF (YMR226c*) was replaced with the *A. aegypti* ADC coding sequence r3 (SEQ ID NO: 160 which encodes the ADC of SEQ ID NO: 162) codon-optimized for expression in *I. orientalis* and synthesized by GeneArt® in the plasmid pMA-T. Plasmid pMA-T with *A. aegypti* ADC coding sequence r3 was digested with NheI-HF and AscI and the resulting fragments were separated by 1% agarose gel electrophoresis in TBE buffer where an approximately 1.7 kbp band was excised from the gel and purified using a QIAQUICK® Gel Extraction Kit according to the manufacturer's instructions. A total of 15 μg of a mini-prep of pMeJi359 was digested with NheI-HF and AscI, treated with 10 units calf intestinal phosphatase (New England Biolabs, Inc.) at 37° C. for one hour, and purified by 1% agarose gel electrophoresis in TBE buffer where an approximately 7.5 kbp band was excised from the gel and purified using a QIAQUICK® Gel Extraction Kit according to the manufacturer's instructions. The NheI-HF/AscI pMeJi359 fragment and the NheI-HF/AscI *A. aegypti* ADC r3 insert were joined together in a ligation reaction (10 μL) composed of 1× Quick ligation buffer (New England Biolabs, Inc.), 1 μL of the NheI-HF/AscI pMeJi359 fragment, 5 μL of the NheI-HF/AscI *A. aegypti* ADC r3 insert, and 1 μL of Quick T4 DNA ligase (New England Biolabs, Inc.). The ligation reaction was incubated for 15 minutes at room temperature, and then placed on ice. Three μL of the reaction were used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired ADC r3 ORF by NcoI and BamHI digestion. A plasmid yielding the desired band sizes was confirmed to be correct by DNA sequencing and designated plasmid pMeJi361.

Plasmid pMeJi361 is a left-hand *I. orientalis* adh2556-targeting construct containing the *I. orientalis* PDC promoter driving expression of an *A. aegypti* ADC r3 coding sequence (SEQ ID NO: 160) codon-optimized for expression in *I. orientalis*, the *I. orientalis* TAL terminator, the *I. orientalis* PDC promoter driving expression of a second *I. orientalis* ymr226c variant gene codon-optimized for expression in *I. orientalis* (YMR226c*r2), the *I. orientalis* RKI terminator, the *I. orientalis* URA3 promoter, and the 5' fragment of the *I. orientalis* URA3 ORF.

The second *I. orientalis* yrm226c variant ORF (YMR226c*r2) was replaced with the *A. aegypti* ADC coding sequence r4 (SEQ ID NO: 161 which encodes the ADC of SEQ ID NO: 162) codon-optimized for expression in *I. orientalis* and synthesized by GeneArt® in the plasmid pMA-T. Plasmid pMA-T with *A. aegypti* ADC r4 was digested with SpeI and the resulting fragments were separated by 1% agarose gel electrophoresis in TBE buffer where an approximately 1.7 kbp band was excised from the gel and purified using a QIAQUICK® Gel Extraction Kit according to the manufacturer's instructions. Eight μg of a mini-prep of pMeJi361 were digested with SpeI at 37° C. for one hour, and purified by 0.9% agarose gel electrophoresis in TBE buffer where an approximately 8.4 kbp band was excised from the gel and purified using a QIAQUICK® Gel Extraction Kit according to the manufacturer's instructions. The SpeI pMeJi361 fragment and the SpeI *A. aegypti* ADC r4 insert were joined together in a ligation reaction (10 μL) composed of 1× Quick ligation buffer, 1 μL of the SpeI pMeJi361 fragment, 5 μL of the SpeI *A. aegypti* ADC r4 insert, and 1 μL of Quick T4 DNA ligase. The ligation reaction was incubated for 15 minutes at room temperature, and then placed on ice. Three μL of the reaction were used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and were screened for proper insertion of the desired ADC r3 ORF by SpeI digestion. Correct orientation was confirmed by PacI and HindIII digestion. A plasmid yielding the desired band sizes was confirmed to be correct by DNA sequencing and designated plasmid pMeJi363 (FIG. 4; SEQ ID NO: 210).

Plasmid pMeJi363 is a left-hand *I. orientalis* adh2556-targeting construct containing the *I. orientalis* PDC promoter driving expression of an *A. aegypti* ADC r3 coding sequence (SEQ ID NO: 160) codon-optimized for expression in *I. orientalis*, the *I. orientalis* TAL terminator, the *I. orientalis* PDC promoter driving expression of a second *A. aegypti* ADC r4 coding sequence (SEQ ID NO: 161) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

Figure 5:
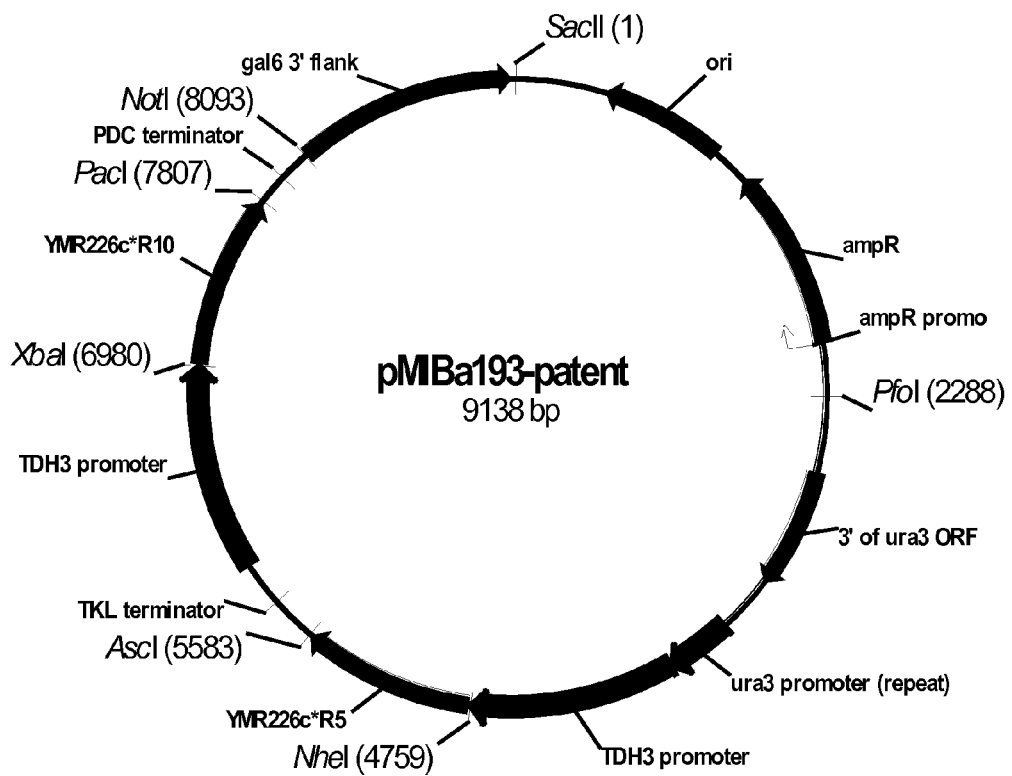
FIG. 5 shows a plasmid map for pMIBa193.

The first cloning step for the right-hand construct was to replace the gal6 3' homology region present in pMIBa193 (FIG. 5) with the adh2556 3' homology region. A PCR product containing the sequence 3' of the adh2556 ORF, along with desired additional restriction sites and flanking DNA for cloning, was amplified with primers 1204012 and 1204013. The amplification reaction was performed using Platinum® pfx DNA polymerase according to manufacturer's instructions. The PCR was composed of 3 μl of an *I. orientalis* MBin500 genomic preparation (WO 2012/074818), 25 pM primer 1204012, 25 pM primer 1204013, 1×pfx amplification buffer, 2 mM MgSO$_4$, and 1.25 units of Platinum® pfx DNA polymerase in a final volume of 50 μl. The reaction was incubated in an EPPENDORF® MASTERCYCLER® programmed for 1 cycle at 95° C. for 2 minutes; 25 cycles each at 95° C. for 1 minute, 55° C. for 1 minute, and 72° C. for 1 minute; and 1 cycle at 72° C. for 3 minutes. Following thermocycling, the PCR products were separated by 1% agarose gel electrophoresis in TBE buffer where an approximately 1 kbp PCR product was excised from the gel and purified using a QIAQUICK® Gel Extraction Kit according to the manufacturer's instructions.

To create a recipient vector for the above PCR product, plasmid pMIBa193 (FIG. 5) was digested with SacII and NotI-HF at 37° C. for 1 hour, and purified by 1% agarose gel electrophoresis in TBE buffer where an approximately 8.1 kbp band was excised from the gel and purified using a QIAQUICK® Gel Extraction Kit according to the manufacturer's instructions. The PCR product and the SacII/NotI-HF pMIBa193 fragment were joined together using an IN-FUSION™ Advantage PCR Cloning Kit in a total reaction volume of 10 μL composed of 161 ng of the SacII/NotI-HF pMIBa193 fragment, 68 ng of the adh2556 3' homology containing PCR product, 1× IN-FUSION™ reaction buffer, and 1 μL of IN-FUSION™ enzyme. The reaction was incubated at 50° C. for 15 minutes, and then placed on ice. The reaction was used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired PCR products by digestion with XmaI and XbaI. A plasmid yielding the desired band sizes was confirmed to be correct by DNA sequencing and designated plasmid pMeJi360.

Plasmid pMeJi360 is a right-hand *I. orientalis* adh2556 targeting construct containing the 3' fragment of the *I. orientalis* URA3 ORF, the *I. orientalis* URA3 promoter, the *I. orientalis* TDH3 promoter driving expression of an *I. orientalis* ymr226c variant gene codon-optimized for expression in *I. orientalis* (YMR226c*r5), the *I. orientalis* TKL terminator, the *I. orientalis* TDH3 promoter driving expression of a second *I. orientalis* ymr226c variant gene codon-optimized for expression in *I. orientalis* (YMR226c*r10), and the *I. orientalis* PDC terminator.

The first *I. orientalis* yrm226c variant ORF (YMR226c*r10) was replaced with the *A. aegypti* ADC coding sequence r10 (SEQ ID NO: 159 which encodes the ADC of SEQ ID NO: 162) codon-optimized for expression in *I. orientalis* and synthesized by GeneArt® in the plasmid pMA-T. Plasmid pMA-T with *A. aegypti* ADC coding sequence r10 was digested with NheI-HF and AscI and the resulting fragments were separated by 1% agarose gel electrophoresis in TBE buffer where an approximately 1.7 kbp band was excised from the gel and purified using a QIAQUICK® Gel Extraction Kit according to the manufacturer's instructions. Five μg of a mini-prep of pMeJi360 were digested with NheI-HF and AscI, treated with 10 units of calf intestinal phosphatase (New England Biolabs, Inc.) at 37° C. for one hour, and purified by 1% agarose gel electrophoresis in TBE buffer where an approximately 7.5 kbp band was excised from the gel and purified using a QIAQUICK® Gel Extraction Kit according to the manufacturer's instructions. The NheI-HF/AscI pMeJi360 fragment and NheI-HF/AscI *A. aegypti* ADC r10 insert were joined together in a ligation reaction (10 μL) composed of 1× Quick ligation buffer, 1 μL of the NheI-HF/AscI pMeJi360 fragment, 5 μL of the NheI-HF/AscI *A. aegypti* ADC r10 insert, and 1 μL of Quick T4 DNA ligase. The ligation reaction was incubated at room temperature for 15 minutes, and then placed on ice. Three μL of the reaction were used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired ADC r10 ORF by NcoI and XbaI digestion. A plasmid yielding the desired band sizes was confirmed to be correct by DNA sequencing and designated plasmid pMeJi362.

Plasmid pMeJi362 is a right-hand *I. orientalis* adh2556 targeting construct containing the 3' fragment of the *I. orientalis* URA3 ORF, the *I. orientalis* URA3 promoter, the *I. orientalis* TDH3 promoter driving expression of an *A. aegypti* ADC r10 coding sequence (SEQ ID NO: 159) codon-optimized for expression in *I. orientalis*, the *I. orientalis* TKL terminator, the *I. orientalis* TDH3 promoter driving expression of a second *I. orientalis* ymr226c variant gene codon-optimized for expression in *I. orientalis* (YMR226c*r10), and the *I. orientalis* PDC terminator.

Figure 6:
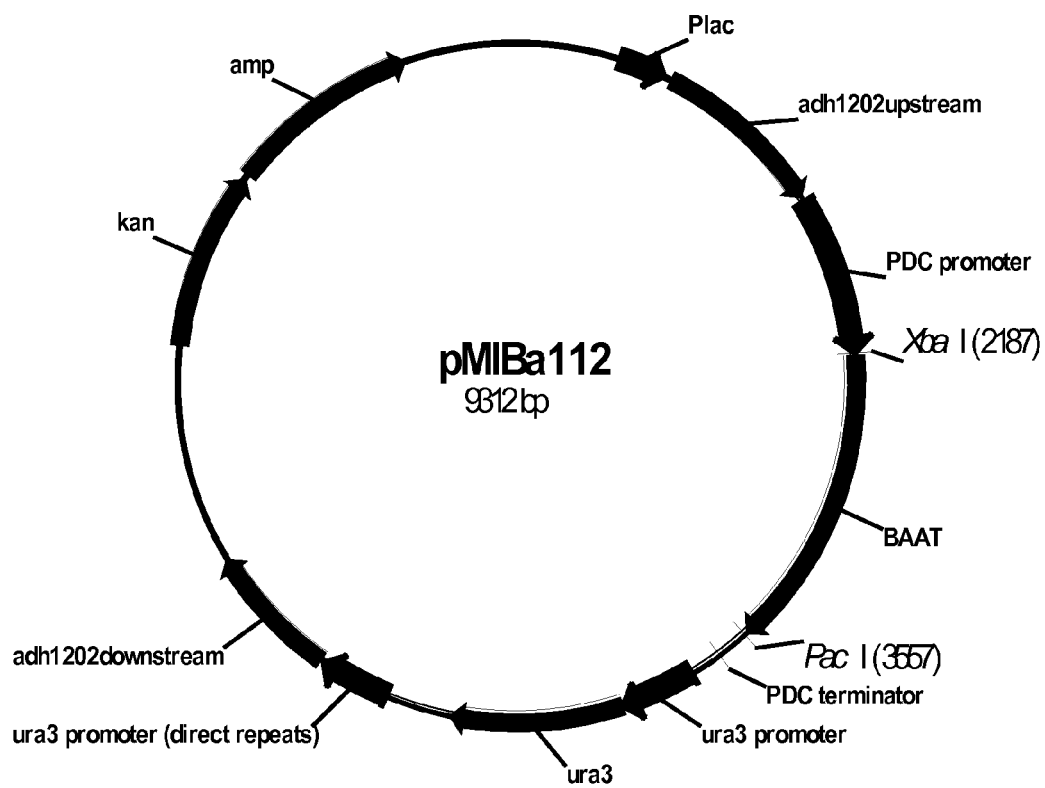
FIG. 6 shows a plasmid map for pMIBa112.

The second *I. orientalis* ymr226c variant ORF (YMR226c*r10) was replaced with an *A. aegypti* ADC coding sequence (SEQ ID NO: 157 which encodes the ADC of SEQ ID NO: 162) codon-optimized for expression in *I. orientalis* and synthesized by GeneArt® in the plasmid pMA-T. First, the pMAT plasmid containing the *A. aegypti* ADC coding sequence was digested with XbaI and PacI and the resulting fragments were separated by 1% agarose gel electrophoresis in TBE buffer where a band of approximately 1.7 kbp was excised from the gel and purified using a QIAQUICK® Gel Extraction Kit according to the manufacturer's instructions. Plasmid pMIBa112 (FIG. 6) was digested with XbaI and PacI and the resulting fragments were separated by 1% agarose gel electrophoresis in TBE buffer where a band of approximately 7.9 kbp was excised from the gel and purified using a QIAQUICK® Gel Extraction Kit according to the manufacturer's instructions. Plasmid pMIBa112 is identical to plasmid pMIBa121 (WO 2012/074818), except pMIBa121 contains the *Streptomyces avermitilis* BAAT sequence codon optimized for *I. orientalis* while pMIBa112 contains the *Streptomyces avermitilis* BAAT sequence codon optimized for *E. coli*. The XbaI/PacI pMIBa112 fragment and the XbaI/PacI *A. aegypti* ADC insert were joined together in a ligation reaction (10 μL) composed of 1× ligation buffer, 1 μL of the XbaI/PacI pMIBa112 fragment, 5 μL of the XbaI/PacI *A. aegypti* ADC insert, and 1 μL of T4 DNA ligase. The ligation reaction was incubated at 16° C. overnight. Three μL of the reaction were used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired ADC ORF by XbaI and PacI digestion. A plasmid yielding the desired band sizes was confirmed to be correct by DNA sequencing as described herein and designated plasmid pMeJi338.

Figure 7:
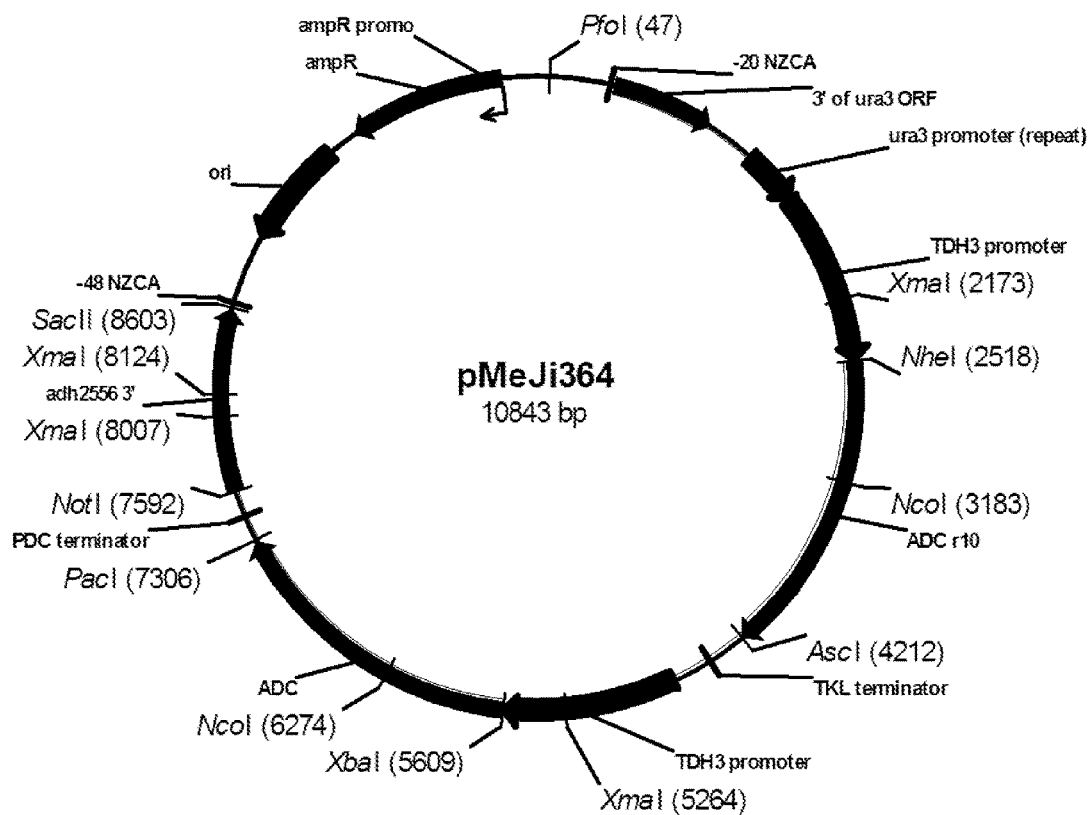
FIG. 7 shows a plasmid map for pMeJi364.

Plasmid pMeJi338 was digested with XbaI and PacI and the resulting fragments were separated by 1% agarose gel electrophoresis in TBE buffer where a band of approximately 1.7 kbp was excised from the gel and purified using a QIAQUICK® Gel Extraction Kit according to the manufacturer's instructions. A total of 3.5 μg of a mini-prep of pMeJi362 was digested with XbaI and PacI at 37° C. for one hour, and purified by 1% agarose gel electrophoresis in TBE buffer where an approximately 9.1 kbp band was excised from the gel and purified using a QIAQUICK® Gel Extraction Kit according to the manufacturer's instructions. The pMeJi362 fragment and *A. aegypti* ADC coding sequence were joined together in a ligation reaction (10 μL) composed of 1× Quick ligation buffer, 1 μL of the XbaI/PacI pMeJi362 fragment, 5 μL of the XbaI/PacI *A. aegypti* ADC insert, and 1 μL of Quick T4 DNA ligase. The ligation reaction was incubated for 15 minutes at room temperature, and then placed on ice. Three μL of the reaction were used to transform ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired ADC ORF by XbaI and PacI digestion. A plasmid yielding the desired band sizes was confirmed to be correct by DNA sequencing and designated plasmid pMeJi364 (FIG. 7; SEQ ID NO: 211).

Plasmid pMeJi364 is a right-hand *I. orientalis* adh2556 targeting construct containing the 3' fragment of the *I. orientalis* URA3 ORF, the *I. orientalis* URA3 promoter, the *I. orientalis* TDH3 promoter driving expression of an *A. aegypti* ADC r10 coding sequence (SEQ ID NO: 159) codon-optimized for expression in *I. orientalis*, the *I. orientalis* TKL terminator, the *I. orientalis* TDH3 promoter driving expression of a second *A. aegypti* ADC coding sequence (SEQ ID NO: 158) codon-optimized for expression in *I. orientalis*, and the *I. orientalis* PDC terminator.

Yeast Strains Expressing Aspartate 1-Decarboxylase (ADC) from Four Nucleotide Sequences at the Adh2556 Locus The Examples above describe creation of left-hand and right-hand constructs for targeting expression of four nucleotide variants of the *A. aegypti* ADC gene codon-optimized for expression in *I. orientalis* at the adh2556 locus. Prior to transformation into *I. orientalis*, 16 μg of pMeJi363 were digested with HpaI and SacII to release the desired transforming DNA from the pUC19 backbone vector. Likewise, 3.2 μg of pMeJi364 were digested with PfoI and SacII to release the desired transforming DNA from the pUC19 backbone vector. An approximately 7.5 kbp containing band (containing the desired expression cassette) was separated from the pMeJi363 DNA by 1% agarose gel electrophoresis in TBE buffer, excised from the gel, and purified using a QIAQUICK® Gel Extraction Kit according to the manufacturer's instructions. An approximately 8.4 kbp band (containing the desired expression cassette) was separated from the pMeJi364 DNA by 1% agarose gel electrophoresis in TBE buffer, excised from the gel, and purified using a QIAQUICK® Gel Extraction Kit according to the manufacturer's instructions. Then 270 ng of the HpaI/SacII pMeJi363 fragment and 105 ng of the PfoI/SacII pMeJi364 fragment were used to transform *I. orientalis* CNB1 as described in Example 1.

Transformants were selected on SD ura− plates and incubated at 37° C. for growth. Transformants were picked the following day and restreaked for single colonies on SD ura− plates (plates lacking uracil) and grown at 37° C. overnight, and then a single colony was picked from each of the streaks generated by each initial transformant and restreaked on SD ura− plates.

Following single colony purification and outgrowth, PCRs were performed to verify desired targeted integration occurred as described herein. Correct targeting of the pMeJi363 and pMeJi364 fragments to the adh2556 locus was verified using primers 1204049 and 0615362, 1204065 and 1204050, and 1204060 and 1204061. Primer 1204049 binds to the adh2556 locus DNA 5' of the region targeted, while primer 0615362 binds to the TAL terminator and amplifies in the anti-sense direction. Generation of an approximately 3.5 kbp band from PCRs with these primers indicates the occurrence of the desired integration event at the adh2556 locus. Primer 1204065 binds to ADC r10, while primer 1204050 binds to the adh2556 locus DNA 3' of the region targeted and amplifies in the anti-sense direction. Generation of an approximately 4.8 kbp band from PCRs with these primers indicates the occurrence of the desired integration event at the adh2556 locus. Primer 1204060 binds to ADC r4, while primer 1204061 binds to the ADC r10 and amplifies in the anti-sense direction. Generation of an approximately 3.5 kbp band from PCRs with these primers indicates the co-location of the two integration fragments at the adh2556 locus.

The PCRs (25 µL) were composed of 1 µL of DNA (one colony suspended in 30 µL of water) for the strain to be screened using a Phire® Plant Direct PCR Kit (Thermo Fisher Scientific, Inc.) according to the manufacturer's instructions. The PCRs were performed in an EPPENDORF® MASTERCYCLER® programmed for 1 cycle at 98° C. for 5 minutes followed by 40 cycles each at 95° C. for 7 seconds, 62° C. for 7 seconds, and 72° C. for 3 minutes, with a final extension at 98° C. for 1 minutes. Following thermocycling, the PCR products were separated by 1% agarose gel electrophoresis in TBE buffer and the sizes of the bands visualized and interpreted as described above. Two independently isolated transformants having the desired bands were designated I. orientalis MeJi523 and MeJi524. The transformant genotype for I. orientalis strains MeJi523 and MeJi524 is shown in Table 5.

TABLE 5

| Strain | Parent strain | Genotype |
|---|---|---|
| MeJi523 | I. orientalis | adh2556Δ::(PDC$_{promo}$-ADC r3, |
| MeJi524 | CNB1 | PDC$_{promo}$-ADC r4, URA3, TDH3$_{promo}$-ADC r10, TDH3$_{promo}$-ADC)/ADH 2556 |

Example 3: Construction of Yeast Strains Expressing a Heterologous Insect Aspartate 1-Decarboxylase at the Adh1202 Locus This Example describes the construction of yeast cells containing four copies of polynucleotides encoding the *Aedes aegypti* ADC of SEQ ID NO: 162 (codon-optimized coding sequences of SEQ ID NOs: 158, 159, 160 and 161) at the adh1202 locus with two copies under control of the *I. orientalis* PDC promoter and two copies under the control of the *I. orientalis* TDH3 promoter. A left-hand construct and a right-hand construct were designed to allow homologous recombination at the *I. orientalis* CNB1 adh1202 locus.

Construction of a Left-Hand Fragment

Plasmid pMeJi363 (Example 2) was digested with NheI and PacI and a fragment containing two *A. aegypti* ADC coding sequences was purified by 1% agarose gel electrophoresis in TBE buffer where a band at approximately 4.5 kbp was excised from the gel and purified using a QIAQUICK® Gel Extraction Kit according to the manufacturer's instructions.

Plasmid pMIBa137 (WO 2012/074818) was digested with NheI and PacI and purified by 1% agarose gel electrophoresis in TBE buffer where a band at approximately 5.5 kbp, containing the 5' region of homology to adh1202, was excised from the gel and purified using a QIAQUICK® Gel Extraction Kit according to the manufacturer's instructions.

Figure 8:
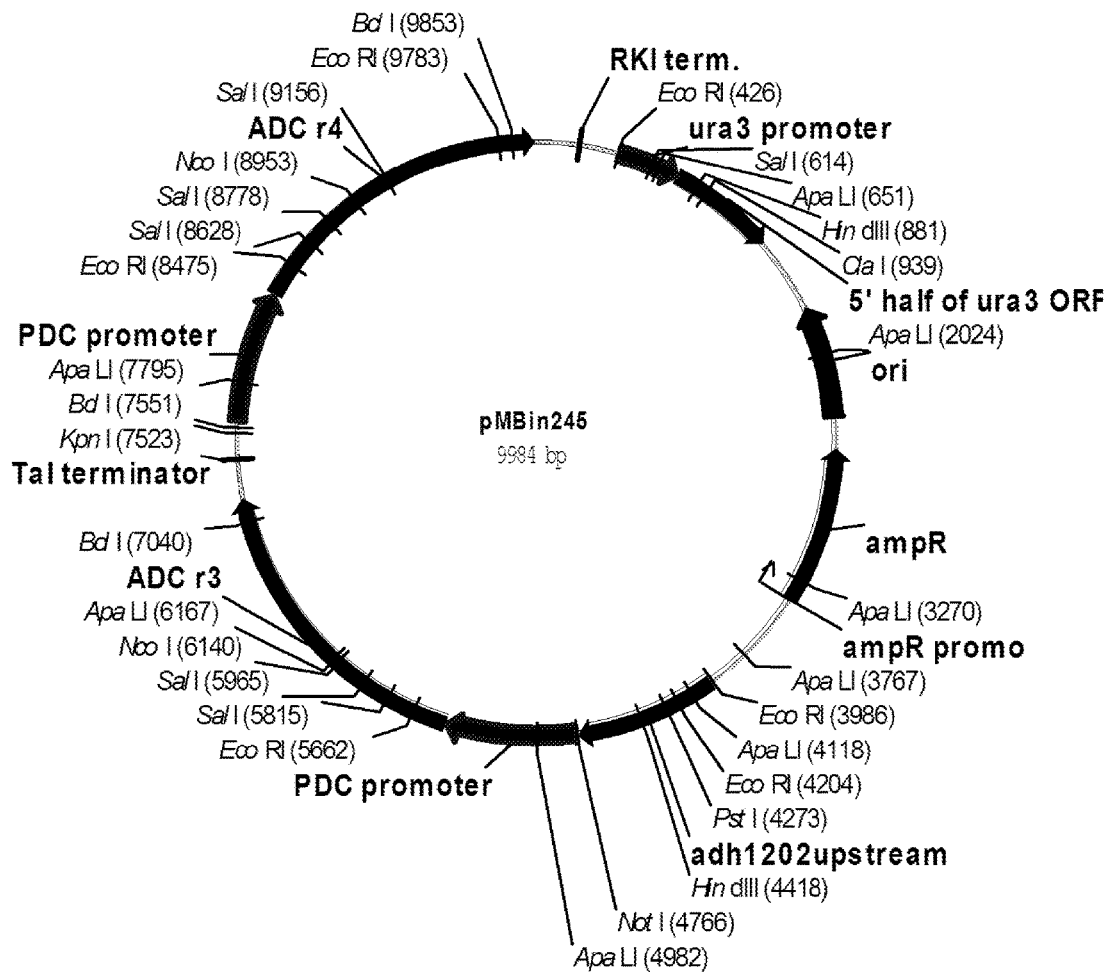
FIG. 8 shows a plasmid map for pMBin245.

The 4.5 kbp NheI/PacI pMeJi363 fragment was ligated to the 5.5 kbp NheI/PacI pMIBa137 fragment using T4 ligase (New England Biolabs, Inc.) in a total reaction volume of 10 µL composed of 2 µL of the 55.5 kbp NheI/PacI pMIBa137 fragment, 6 µL of the NheI/PacI pMeJi363 fragment, 1 µL of 10× ligation buffer with 10 mM ATP (New England Biolabs, Inc.), and 1 µL of T4 ligase. The reaction was incubated overnight at 16° C. and a 4 µL aliquot of the reaction was transformed into ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion by restriction digestion with NcoI and PstI. A plasmid yielding the correct digested band sizes was designated plasmid pMBin245 (see FIG. 8).

Construction of a Right-Hand Fragment

Plasmid pMeJi364 (Example 2) was digested with NheI and PacI and purified by 1% agarose gel electrophoresis in TBE buffer. A fragment containing two *A. aegypti* ADC coding sequences at approximately 4.8 kbp was excised from the gel and purified using a QIAQUICK® Gel Extraction Kit according to the manufacturer's instructions.

Plasmid pMIBa136 (WO 2012/074818) was digested with NheI and PacI and purified by 1% agarose gel electrophoresis in TBE buffer. A band at approximately 5.7 kbp, containing the 3' region of homology to adh1202, was excised from the gel and purified using a QIAQUICK® Gel Extraction Kit according to the manufacturer's instructions.

Figure 9:
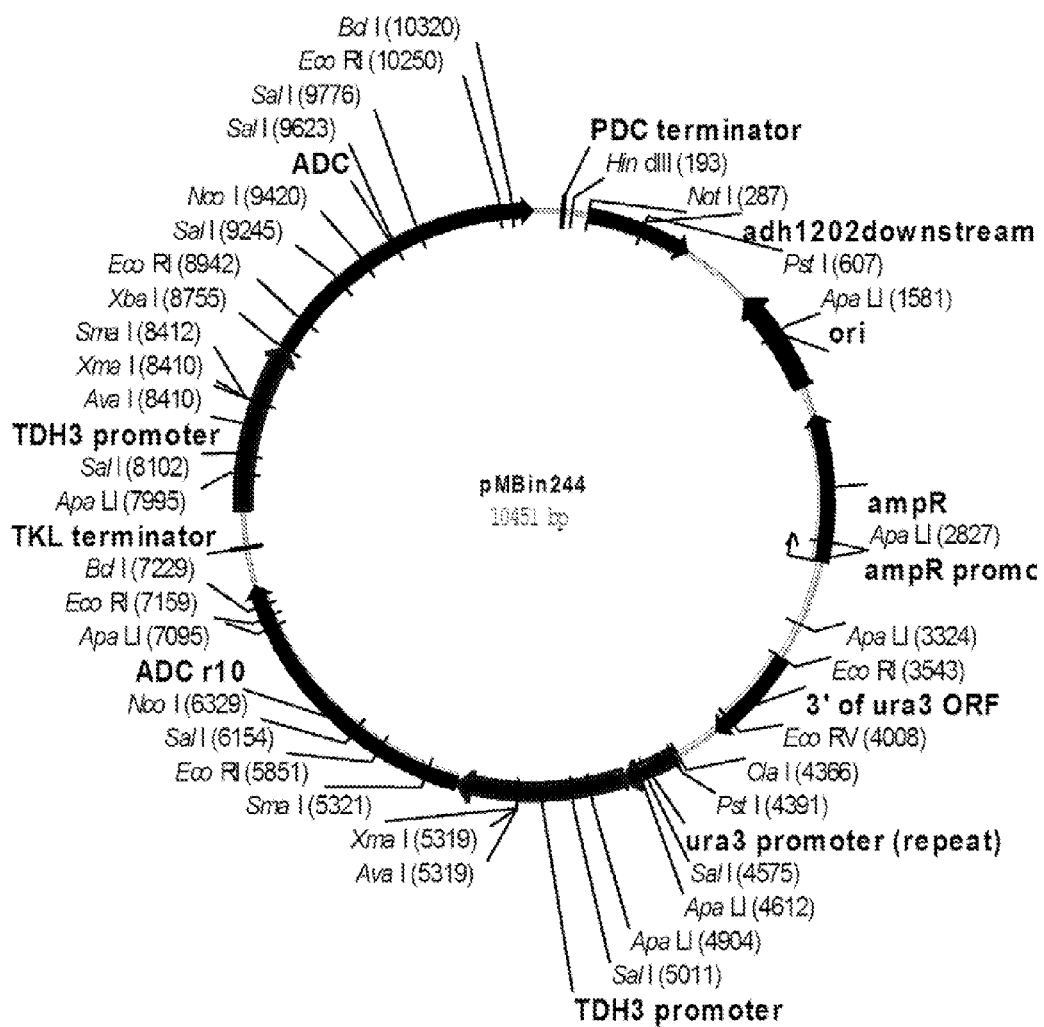
FIG. 9 shows a plasmid map for pMBin244.

The 4.8 kbp NheI/PacI pMeJi364 fragment was ligated to the 5.7 kbp NheI/PacI pMIBa136 fragment in a total reaction volume of 10 µL composed of 2 µL of the NheI/PacI pMIBa136 fragment, 6 µL of the NheI/PacI pMeJi364 fragment, 1 µL of 10× ligation buffer with 10 mM ATP, and 1 µL of T4 ligase. The reaction was incubated overnight at 16° C. and a 4 µL aliquot of the reaction was transformed into ONE SHOT® TOP10 chemically competent *E. coli* cells according to manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion by restriction digestion with NcoI and PstI. A plasmid yielding the correct digested band sizes was designated plasmid pMBin244 (see FIG. 9).

Integration of the Left-Hand and Right-Hand Fragments

Plasmid pMBin245 was digested with HpaI and SacII and plasmid pMBin244 was digested with KasI and SacII. The digestions were purified by 1% agarose gel electrophoresis in TBE buffer where approximately 7.3 kbp (from pMBin245) and 7.9 kbp (from pMBin244) bands were excised from the gels and purified using a QIAQUICK® Gel Extraction Kit according to the manufacturer's instructions.

*I. orientalis* CNB1 was transformed with the HpaI/SacII pMBin245 fragment and the KasI/SacII pMBin244 fragment and correct loci targeting and transformation were verified using a Phire® Plant Direct PCR Kit according to the manufacturer's instructions. Primers 0611631 and 0611245 yielded a band of approximately 6.1 kbp, and primers 0611632 and 0611317 yielded an approximately 7.9 kbp band. A strain with the expected bands for proper integration of the expression cassette was designated *I. orientalis* MBin608. The different integration sites were shown not to matter (see Example 5). The genotype for *I. orientalis* MBin608 is shown in Table 6.

TABLE 6

| Strain | Parent strain | Genotype |
|---|---|---|
| MBin608 | *I. orientalis* CNB1 | adh1202Δ::(PDC$_{promo}$-ADC r3, PDC$_{promo}$-ADC r4, URA3, TDH3$_{promo}$-ADC r10, TDH3$_{promo}$-ADC)/ADH1202 |

Example 4: 3-HP Production in Recombinant Yeast Strains Expressing a Heterologous Insect Aspartate 1-Decarboxylase or a Heterologous *Bacillus licheniformis* Aspartate 1-Decarboxylase This Example describes 3-HP production characteristics in yeast strains expressing four copies of polynucleotides encoding an insect ADC at the adh2556 locus (strains MeJi523 and Meji524, Example 2) compared to yeast strains expressing four copies of polynucleotides encoding the *Bacillus licheniformis* ADC (SEQ ID NO: 139) at the adh1202 locus (*I. orientalis* MIBa351; see WO 2012/074818). The genotype for *I. orientalis* MBin351 is shown in Table 7.

TABLE 7

| Strain | Parent strain | Genotype |
|---|---|---|
| MIBa351 | *I. orientalis* CNB1 | adh1202Δ::(PDC$_{promo}$-panDBI r1, PDC$_{promo}$-panDbI r5, URA3, TDH3$_{promo}$-panDbI r7, TDH3$_{promo}$-panDbI r10)/ADH 1202 |

Recombinant yeast strains *I. orientalis* MIBa351, MeJi523 and Meji524 were cultivated using a seed propagation stage, followed by a single stage fermentation in a 3 L bioreactor (Applikon, Foster City, Calif., USA).

For seed stage preparation 25 mL of DM2 medium having a final concentration of 0.1 M MES were added to a 125 mL baffled flask, followed by inoculation with the strain of interest using a sterile loop. The culture was grown at the desired temperature overnight for approximately 16 hours with shaking at 250 rpm. Small aliquots of the culture were then withdrawn at approximately hourly intervals to measure the OD$_{600}$ until reaching an OD$_{600}$ of 4-6.

The residual glucose present was measured using an Uristix® Reagent Strip (Bayer Healthcare). Twelve mL of the culture were then added to 4 mL of sterile chilled 75% glycerol, mix thoroughly, and incubated on ice for ten minutes. The culture and glycerol mixture were then remixed and 1.0 mL were aliquoted to each of 10 sterile 1.8 mL cryovials (Thermo Fisher Scientific, Inc.) and stored at −80° C.

One day prior to the fermentations, the cryovials were thawed at room temperature. For each strain 80 µl of the corresponding cryovial solution were used to inoculate a 125 mL shake flask containing 30 mL of DM2 medium having a final concentration of 0.07 M MES. The culture was grown at the desired temperature overnight for approximately 16 hours with shaking at 250 rpm. This culture was then used to inoculate a 125 mL shake flask containing 30 mL of DM2 medium having a final concentration of 0.07 M MES at an OD$_{600}$ of 0.2. After about 8 hours of cultivation 25 mL of the seed flask cultivations were used to inoculate the 3 L bioreactor containing 1.5 liters of DM2 medium and 1 mL of antifoam A (Sigma-Aldrich). The fermentation was performed at a temperature of about 30° C.-40° C., with the pH controlled in the range of about 2.0-7.0 and under agitation and aeration conditions that lead to an oxygen uptake rate (OUR) in the range of 2-45 mmol/L/hr. In the Examples presented herein, the temperature, pH and OUR for the culture in the bioreactor were 30° C., 4.0 and 10-30, respectively. The tanks were fed when necessary with a solution of 60% glucose in order to avoid glucose limitation.

For analysis of 3-HP and 6-alanine, culture samples were removed and filtered through a 0.45 µm 96-well filter plate and further diluted 10× in 0.2% NH$_4$OH. Further dilution was made in water depending on the analyte concentration in the sample. A further 10× dilution was made in a sample buffer of 20% methanol, 1 mM ammonium acetate, 0.1% ammonium hydroxide, and 15 mg/L of $^{13}$C uniformly labeled 3-HP (as internal standard for 3-HP), or 20% methanol, 1% formic acid, and 3 mg/L of $^{13}$C uniformly labeled β-alanine (as internal standard for β-alanine). The total dilution factor was approximately 100 to 1000 depending on the concentrations of β-alanine or 3-HP.

A 2 µL sample was injected into an Agilent 1200 HPLC (Agilent Technologies, Inc.) controlled by a MassHunter program (Agilent Technologies, Inc.) with an Agilent 6410 Triple Quad MS/MS detector using the instrument settings and columns listed in Table 8. The ratio of the quantifying ion fragment peak area to its stable isotope counterpart (from internal standard) was used for quantification to eliminate the effect of ion suppression and instrument drifting. Standard deviation was below 5% from day to day assays.

TABLE 8

| | 3-HP ($^{13}$C 3-HP) | β-Alanine ($^{13}$C β-Alanine) |
|---|---|---|
| Column | Xbridge HILIC Silica 3.5 µm, 2.1 × 150 mm | Atlantis HILIC Silica 3 µm 2.1 × 150 mm |
| Elution buffer | 62% acetonitrile, 0.35 mM NH$_4$Ac | 38% acetonitrile, 0.6% formic acid |
| Flow rate (mL/min) | 0.30 | 0.30 |
| Column temperature | 45° C. | 50° C. |
| Retention time (min) | 1.07 | 1.64 |
| Run time (min) | 3 | 3 |
| Precursor ion | 89 (92) | 90 (93) |
| Production as quantifier | 59 (61) | 72 (75) |
| Production as qualifier | 41 (43) | 30 (31) |
| Fragmentor Voltage | 50 | 70 |
| Collision energy | 5 for quantifier; 21 for qualifier | 3 for quantifier; 7 for qualifier |
| Ion mode | ESI Negative | ESI Positive |
| Nebulizer N$_2$ pressure (psi) | 10 | 10 |

TABLE 8-continued

| | 3-HP ($^{13}$C 3-HP) | β-Alanine ($^{13}$C β-Alanine) |
|---|---|---|
| N$_2$ flow (L/min) | 32 | 32 |
| N$_2$ temperature | 300° C. | 300° C. |
| Capillary (V) | 4000 | 4000 |
| Delta EMV | 450 | 450 |

Glucose consumed was measured following the protocol of a commercially available Kit: "Liquid Glucose Oxidase Reagent Set" (Pointe Scientific, Inc.).

Figure 10:
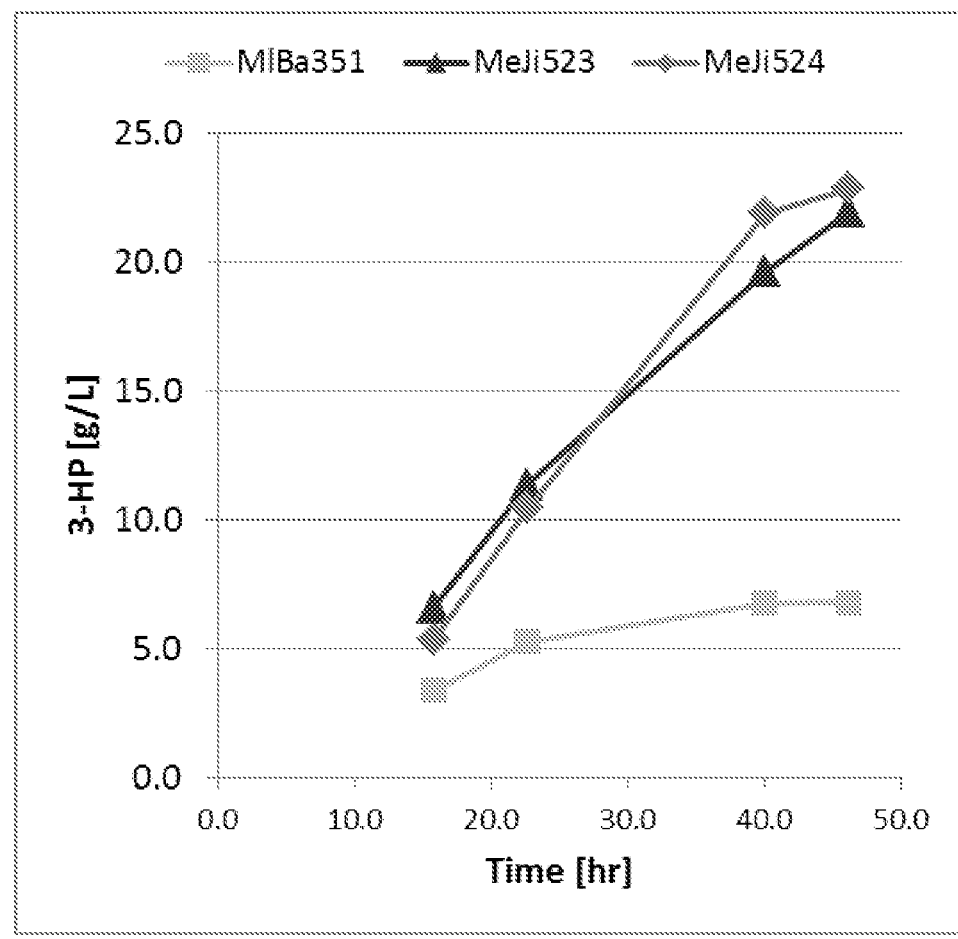
FIG. 10 shows a fermentation plot of 3-HP at various time points.

The resulting fermentations for *I. orientalis* MIBa351, MeJi523 and MeJi524 are shown in FIG. 10 (3-HP concentration at various time points) and Table 9 (3-HP concentration and yield after 46 hours of fermentation). *I. orientalis* MeJi523 and MeJi524 (which express the *Aedes aegypti* insect ADC of SEQ ID NO: 162) showed significant improvement in both 3-HP production and 3-HP yield compared to corresponding strain *I. orientalis* MIBa351 (which expresses the *Bacillus licheniformis* ADC of SEQ ID NO: 139).

TABLE 9

| Strain | [3-HP] (g/L) | 3-HP (yield) |
|---|---|---|
| MIBa351 | 6.8 | 2.4% |
| MeJi523 | 21.9 | 8.3% |
| MeJi524 | 22.8 | 8.4% |

Example 5: 3-HP Production in Recombinant Yeast Strains Expressing a Heterologous Insect Aspartate 1-Decarboxylase at Different Loci This Example describes 3-HP production characteristics in yeast strains expressing four copies of polynucleotides encoding an insect ADC at either the adh2556 locus (strain Meji524, Example 2) or the adh1202 locus (strain MBin608, Example 3).

Figure 11:
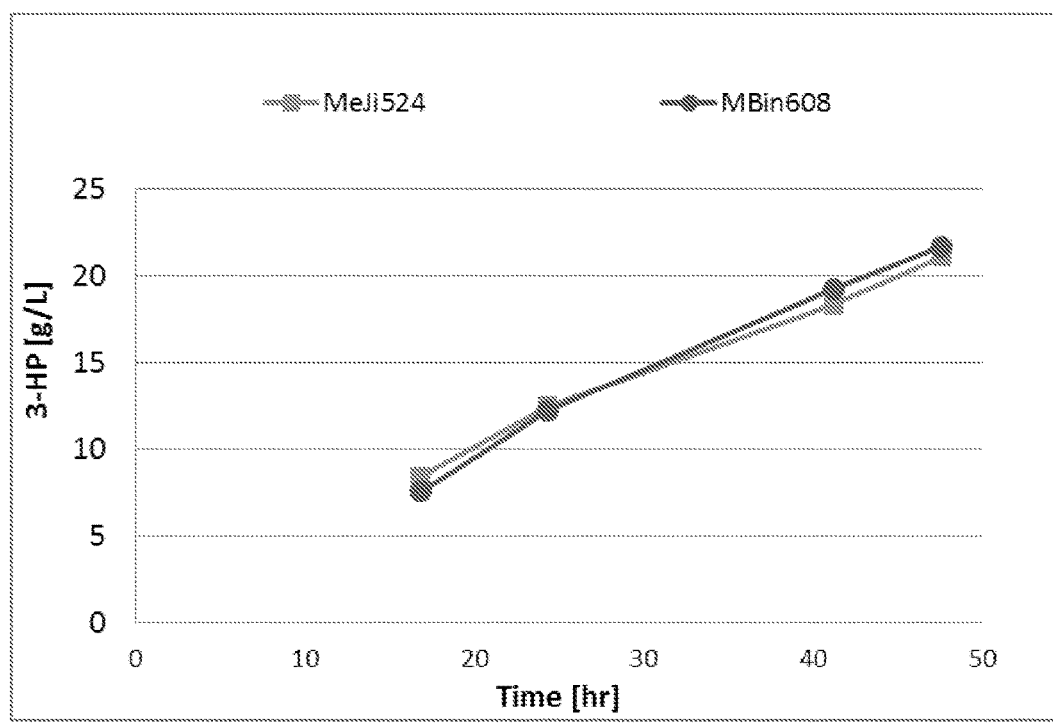
FIG. 11 shows a fermentation plot of 3-HP at various time points.

Cultivation medium and conditions as well as analytical methods were the same as in Example 4. The resulting fermentation for strains *I. orientalis* MeJi524 and MBin608 is shown in FIG. 11 (3-HP concentration at various time points) and Table 10 (3HP concentration and yield after 48 hours of fermentation). Strains *I. orientalis* MeJi524 and MBin608 performed the same indicating no effect of the locus of insertion for the insect ADC coding sequence on 3-HP production and yield.

TABLE 10

| Strain | [3-HP] (g/L) | 3-HP (yield) |
|---|---|---|
| MeJi524 | 21.1 | 11.9% |
| MBin608 | 21.7 | 10.6% |

Example 6: Enzymatic Activity of Recombinant Yeast Strains Expressing a Heterologous Insect Aspartate 1-Decarboxylase Gene Preparation of Cultures for Cell Free Extracts

*I. orientalis* strains MeJi523, MeJi524, MIBa351, and MBin608 were grown in shake flasks according to the following procedure. The strains were streaked onto SD ura– plates for single colonies and incubated at 30° C. for 1-2 days. Seed cultures were prepared in 250 ml baffled flasks containing 50 mL of CNB1 medium inoculated with 1-2 colonies from the SD ura– plates. The seed cultures were grown for approximately 18 hours at 30° C. with shaking at 200 rpm. Small aliquots of the cultures were then withdrawn to measure the OD$_{600}$ until reaching an OD$_{600}$ of 4-6. The seed flask cultures were diluted to an OD$_{600}$=0.125 and used to inoculate 125 ml baffled flasks containing 50 mL of CNB1 medium. Cultures were incubated at 30° C. for 20 hours with shaking at 140 rpm.

Preparation of Crude Cell-Free Extracts (CFE) for Enzyme Assays:

The recombinant yeast strains were each collected by centrifugation, the supernatants discarded, and the cell pellets washed with an equal volume of phosphate-buffer saline (PBS). Shake flasks were assayed for enzymatic activity. For preparation of crude cell-free extracts (CFE), each cell pellet was resuspended to an equivalent OD$_{600}$ of 25 with PBS containing 1% Protease Inhibitor Cocktail (Roche Diagnostics) and 10 mM potassium phosphate pH 7. Each cell suspension was transferred to a 2.0 mL microcentrifuge tube with 2.4 g of Lysing Matrix Y (0.5 mm yttria-stabilized zirconium spheres; MP Biomedicals), and cell lysis was performed using a FastPrep®-24 disruptor (MP Biomedicals) for 3 rounds at a setting 6.5/50 seconds. Sample tubes were cooled on ice for 3 minutes between each round. After lysis, the samples were centrifuged at maximum speed in a microcentrifuge for 10 minutes at 4° C. The supernatants were transferred to fresh tubes and kept on ice or stored at –20° C. until use. Total protein concentrations in the lysates were determined using a BCA Protein Assay Reagent Kit (Thermo Fisher Scientific Inc.) with bovine serum albumin as the standard, according to the instructions provided by the manufacturer.

Aspartate 1-Decarboxylase Activity Assay:

ADC activity in CFE of the indicated cells herein was determined as follows: 29 µL of 100 mM ammonium acetate buffer (pH 6 or 7.6), 160 µL of 25 mM aspartate (pH adjusted to 6 or 7.6 with NaOH), and 1 µL of 30 mM pyridoxal-5-phosphate were added to each well of a 96-well microtiter plate thermostatted at 30° C. or 40° C. The reaction was initiated by adding 10 µL of CFE. At different time intervals (2, 4, 6, 8, 10 minutes), 20 µL of sample were withdrawn from the reaction mixture and added to 180 µL of quenching buffer (2.5% formic acid) and then transferred 1:10 into 20% methanol/80% water with 2 mg/L of $^{13}$C labeled β-alanine as internal standard. After filtration, β-alanine in the sample was analyzed by LC/MS/MS (Agilent 1200 series HPLC with Agilent 6410 Triple Quad LC/MS detector). Slopes were obtained from β-alanine vs time plots. Activity was calculated by dividing the slope by total cellular protein concentration in the reaction. ADC activity was expressed as µmoles β-alanine formed/minute/mg protein.

Figure 12:
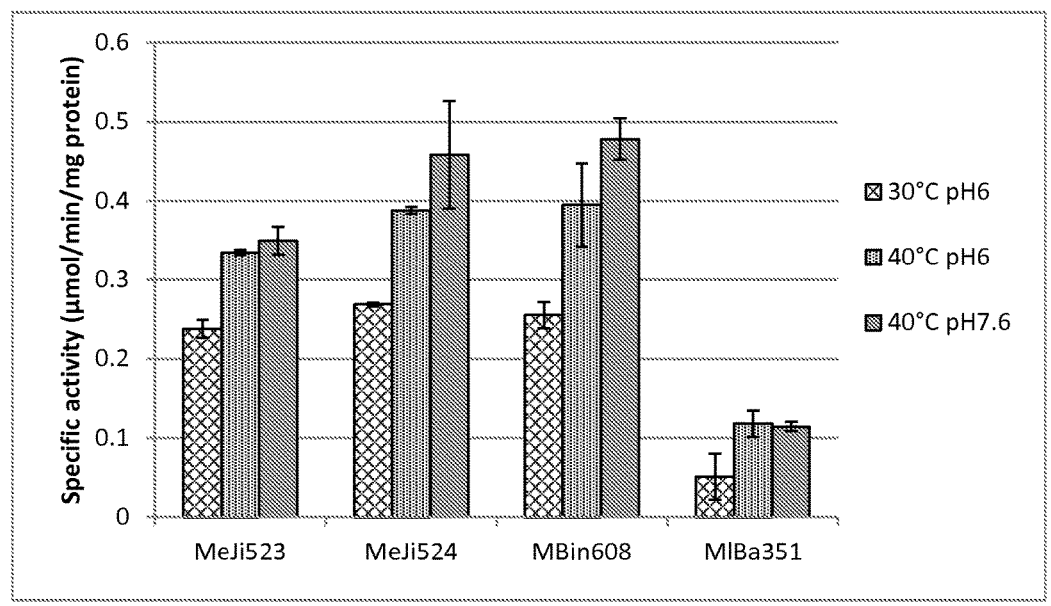
FIG. 12 shows the ADC specific activity of strains *I. orientalis* MeJi523, MeJi524, MBin608, and MIBa351 at 30° C., pH 6 and 40° C., pH 6 and pH 7.6.

The resulting ADC activities for strains *I. orientalis* MIBa351, MeJi523 and MeJi524 and MBin608 are shown in FIG. 12 (rate of β-alanine produced in vitro). *I. orientalis* MeJi523, MeJi524 and MBin608 (which express the *Aedes aegypti* insect ADC of SEQ ID NO: 162) showed significant improvement in specific activity relative to *I. orientalis* MIBa351 (which expresses the *Bacillus licheniformis* ADC of SEQ ID NO: 139). Included in the Figure is a range of conditions (pH and temperature) to minimize the specific activity differences due to differing optimal conditions for the different enzyme families.

Example 7: Construction of Plasmids for Targeting the Pdc Locus

This Example describes the construction of plasmids pMHCT111 and pMHCT112, a left-hand and a right-hand construct pair, that allow integration via homologous recombination of four copies of the *Bacillus licheniformis* ADC coding sequence at the *I. orientalis* CNB1 pdc locus. These plasmids serve as the recipient vectors used for the testing of the insect ADCs at the pdc locus, as described in the Examples below.

Plasmid pMHCT082 (WO 2012/074818) was digested with NheI and PacI and the resulting fragments were separated by 0.9% agarose gel electrophoresis in TAE buffer where an approximately 4.7 kbp band was excised from the gel and purified using a NUCLEOSPIN® Extract II Kit (Macherey-Nagel Inc.) according to the manufacturer's instructions. Plasmid pMIBa137 (WO 2012/074818) was digested with NheI and PacI and the resulting fragments were separated by 0.9% agarose gel electrophoresis in TAE buffer where an approximately 1.9 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 1 µl of the NheI/PacI pMhCT082 fragment, 3 µl of the NheI/PacI pMIBa137 insert fragment, and 1 µl of Quick T4 DNA ligase. The ligation reaction was incubated at room temperature for 5 minutes, and then cooled on ice. Five µl of the reaction were used to transform SoloPack® Gold Competent Cells (Agilent Technologies, Inc.) according to the manufacturer's instructions. The transformation reaction was spread onto 2×YT+amp plates and incubated at room temperature for approximately 72 hours. Putative transformant colonies were isolated from the selection plates and plasmid DNA was prepared from each one using a BIOROBOT® 9600 and screened for proper insertion of the desired fragment from pMIBa137 using ApaLI. One transformant was identified as containing the proper insertion of the pMIBa137 fragment and the plasmid was designated pMHCT111.

Plasmid pMHCT071 (WO 2012/074818) was digested with PmeI and PacI and the resulting fragments were separated by 0.9% agarose gel electrophoresis in TAE buffer where an approximately 4.7 kbp band was excised from the gel and purified using a NUCLEOSPIN® Extract II Kit according to the manufacturer's instructions. Plasmid pMIBa136 (WO 2012/074818) was digested with PmeI and PacI and the resulting fragments were separated by 0.9% agarose gel electrophoresis in TAE buffer where an approximately 3.2 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 1 µl of the PmeI/PacI pMhCT071 fragment, 3 µl of the PmeI/PacI pMIBa136 insert fragment, and 1 µl of Quick T4 DNA ligase. The ligation reaction was incubated at room temperature for 5 minutes, and then cooled on ice. Five µl of the reaction were used to transform SoloPack® Gold Competent Cells according to the manufacturer's instructions. The transformation reaction was spread onto 2×YT+amp plates and incubated at room temperature for approximately 72 hours. Putative transformant colonies were isolated from the selection plates and plasmid DNA was prepared from each one using a BIOROBOT® 9600 and screened for proper insertion of the desired fragment from pMIBa136 using ApaLI digestion. One transformant was identified as containing the proper insertion of the pMIBa136 fragment and the plasmid was designated pMHCT112.

Example 8: Construction of Yeast Strains Expressing a Heterologous Insect Aspartate 1-Decarboxylase from *D. plexippus* at the Pdc Locus This Example describes the construction of yeast cells containing four copies of polynucleotides encoding the *Danaus plexippus* ADC of SEQ ID NO: 170 (codon-optimized coding sequences of SEQ ID NOs: 212, 213, 214 and 215) at the pdc locus with two copies under control of the *I. orientalis* PDC promoter and two copies under the control of the *I. orientalis* TDH3 promoter. A left-hand construct and a right-hand construct were designed to allow homologous recombination at the *I. orientalis* CNB1 pdc locus. To prevent recombination from occurring between the multiple copies of the nucleotide sequences encoding the same ADC sequence, four distinct nucleotide sequences codon-optimized for expression in *I. orientalis* were designed to encode the same ADC sequence.

Construction of a Left-Hand Fragment

The first cloning step for the left-hand construct was to replace the 5' *Aedes aegypti* ADC coding sequence in pMBin249 (Example 10) with the *Danaus plexippus* ADC coding sequence r2 (DpADC r2; SEQ ID NO: 212 which encodes the ADC of SEQ ID NO: 170) codon-optimized for expression in *I. orientalis* and synthesized by GeneArt® in the plasmid pMK-RQ. The DpADC r2 plasmid was digested with NheI and AscI and the resulting fragments were separated by 0.9% agarose gel electrophoresis in TAE buffer where an approximately 1.5 kbp band was excised from the gel and purified using a NUCLEOSPIN® Extract II Kit according to the manufacturer's instructions. Plasmid pMBin249 was digested with NheI-HF and AscI and the resulting fragments were separated by 0.9% agarose gel electrophoresis in TAE buffer where an approximately 7.5 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 0.5 µl of the NheI/AscI pMBin249 fragment, 5 µl of the NheI/AscI DpADC r2 insert, and 1 µl of Quick T4 DNA ligase. The ligation reaction was incubated at room temperature for 5 minutes, and then cooled on ice. Five µl of the reaction were used to transform Stellar™ Competent Cells (Clontech Laboratories, Inc.) according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r2 fragment by EcoRI and BglII digestion. One transformant was identified as containing the proper insertion of the desired r2 fragment and the plasmid was designated pMHCT235.

The next cloning step for the left construct was to remove the remaining *Aedes aegypti* ADC coding sequence and replace it with another *Danaus plexippus* ADC coding sequence. The *Danaus plexippus* ADC coding sequence r3 (DpADC r3; SEQ ID NO: 213 which encodes the ADC of SEQ ID NO: 170) codon-optimized for expression in *I. orientalis* was synthesized by GeneArt® in the plasmid pMK-RQ. The DpADC r3 plasmid was digested with SpeI and the resulting fragments were separated by 0.9% agarose gel electrophoresis in TAE buffer where an approximately 1.5 kbp band was excised from the gel and purified using a NUCLEOSPIN® Extract II Kit according to the manufacturer's instructions. Plasmid pMHCT235 was digested with SpeI. The 5"-phosphate groups were removed by addition of 1 µl of calf intestinal phosphate enzyme (New England Biolabs, Inc.) and incubation at 37° C. for 20 minutes. The resulting fragments were separated by 0.9% agarose gel electrophoresis in TAE buffer where an approximately 7.3 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 2 µl of the SpeI pMHCT235 fragment, 5 µl of the SpeI DpADC r3 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r3 fragment by BglII digestion. One transformant was identified as containing the proper insertion of the desired r3 fragment and the plasmid was designated pMHCT238.

Figure 13:
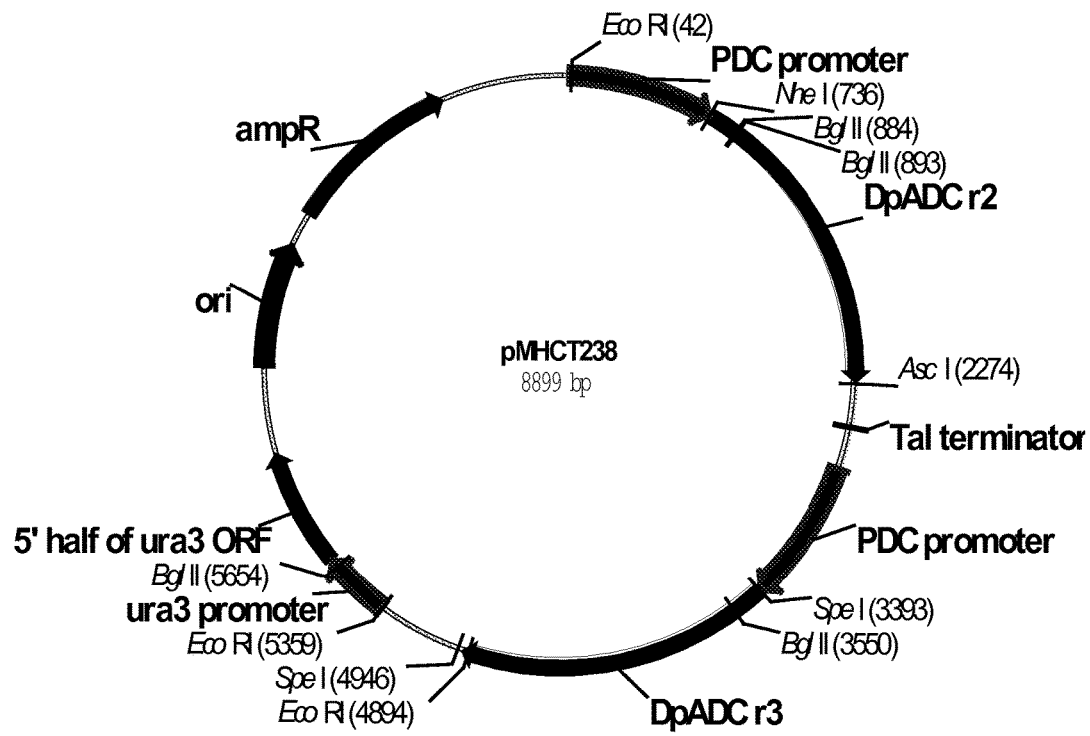
FIG. 13 shows a plasmid map for pMHCT238.

Plasmid pMHCT238 (FIG. 13) is a left-hand *I. orientalis* PDC targeting construct containing the *I. orientalis* PDC promoter driving expression of the *D. plexippus* ADC r2 coding sequence (SEQ ID NO: 212) codon-optimized for expression in *I. orientalis*, the *I. orientalis* TAL terminator, the *I. orientalis* PDC promoter driving expression of the second *D. plexippus* ADC r3 coding sequence (SEQ ID NO: 213) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

The first cloning step for the right-hand construct was to replace the 3' *Aedes aegypti* ADC coding sequence in pMBin250 (Example 10) with the *Danaus plexippus* ADC coding sequence r5 (DpADC r5; SEQ ID NO: 215 which encodes the ADC of SEQ ID NO: 170) codon-optimized for expression in *I. orientalis* and synthesized by GeneArt® in the plasmid pMK-RQ. The DpADC r5 plasmid was digested with XbaI and PacI and the resulting fragments were separated by 0.9% agarose gel electrophoresis in TAE buffer where an approximately 1.5 kbp band was excised from the gel and purified using a NUCLEOSPIN® Extract II Kit according to the manufacturer's instructions. Plasmid pMBin250 (Example 10) was digested with XbaI and PacI and the resulting fragments were separated by 0.9% agarose gel electrophoresis in TAE buffer where an approximately 8.8 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 0.5 µl of the XbaI/PacI pMBin250 fragment, 5 µl of the XbaI/PacI DpADC r5 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r5 fragment by EcoRI and BglII digestion. One transformant was identified as containing proper insertion of the desired r5 fragment and the plasmid was designated pMHCT237.

The next cloning step for the right construct was to remove the remaining *Aedes aegypti* ADC coding sequence and replace it with another *Danaus plexippus* ADC coding sequence. The *Danaus plexippus* ADC coding sequence r4 (DpADC r4; SEQ ID NO: 214 which encodes the ADC of SEQ ID NO: 170) codon-optimized for expression in *I. orientalis* was synthesized by GeneArt® in the plasmid pMK-RQ. The DpADC r4 plasmid was digested with NheI and AscI and the resulting fragments were separated by 0.9% agarose gel electrophoresis in TAE buffer where an approximately 1.5 kbp band was excised from the gel and purified using a NUCLEOSPIN® Extract II Kit according to the manufacturer's instructions. Plasmid pMHCT237 was digested with NheI and AscI and the resulting fragments were separated by 0.9% agarose gel electrophoresis in TAE buffer where an approximately 8.6 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 2 µl of the NheI/AscI pMHCT237 fragment, 5 µl of the NheI/AscI DpADC r4 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r4 fragment by BglII digestion. One transformant was identified as containing the desired r4 fragment and was designated pMHCT239.

Figure 14:
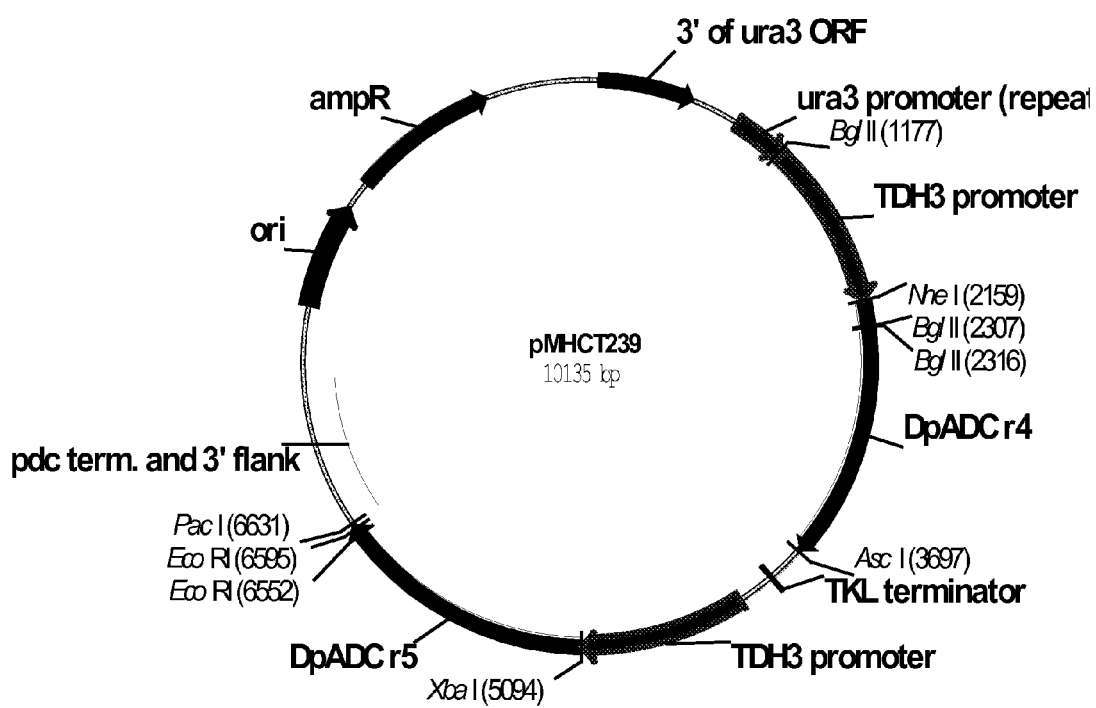
FIG. 14 shows a plasmid map for pMHCT239.

Plasmid pMHCT239 (FIG. 14) is a right-hand *I. orientalis* PDC targeting construct containing the 3' fragment of the *I. orientalis* URA3 ORF, the *I. orientalis* URA3 promoter, the *I. orientalis* TDH3 promoter driving expression of the *D. plexippus* ADC r4 coding sequence (SEQ ID NO: 214) codon-optimized for expression in *I. orientalis*, the *I. orientalis* TKL terminator, the *I. orientalis* TDH3 promoter driving expression of the second *D. plexippus* ADC r5 coding sequence (SEQ ID NO: 215) codon-optimized for expression in *I. orientalis*, and the *I. orientalis* PDC terminator.

Integration of the Left-Hand and Right-Hand Fragments

Prior to transformation, 30 µg of pMHCT238 were digested with NotI to release the desired transforming DNA from the pUC19 backbone vector. Likewise, 30 µg of pMHCT239 were digested with NotI to release the desired transforming DNA from the pUC19 backbone vector. For pMHCT238, an approximately 6.3 kbp band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. For pMHCT239, an approximately 7.5 kbp band (containing the desired expression cassette) was separated from the vector DNA by 0.9% agarose gel electrophoresis in TAE buffer, excised from the gel, and purified using a NUCLEO-SPIN® Extract II Kit according to the manufacturer's instructions. Then 1255 ng of the NotI pMHCT238 fragment and 1880 ng of the NotI pMHCT239 fragment were used to transform *I. orientalis* CNB1 as described in Example 1.

Transformants were selected on SD ura– plates at 37° C. Eighteen transformants were picked the following day and restreaked for single colonies on SD ura– plates (plates lacking uracil) and grown at 37° C. overnight. Then a single colony was picked from each of the streaks generated by each initial transformant and restreaked on SD ura– plates.

Following the round of single colony purification and outgrowth, PCRs were performed to verify the desired targeted integration occurred as described herein. Correct targeting of the pMHCT238 and pMHCT239 fragments to the adh2556 locus was verified using primers 0615988 and 0611245 as well as primers 0612908 and 0615989. Primer 0615988 binds in the pdc locus 5' of the region targeted, while primer 0611245 binds to the RKI terminator and amplifies in the anti-sense direction. Generation of an approximately 5.1 kbp band by PCR with these primers indicates the occurrence of the desired integration event at the pdc locus. Primer 0612908 binds in the URA3 coding region, while primer 0615989 binds in the pdc locus 3' of the region targeted and amplifies in the anti-sense direction. Generation of an approximately 7.2 kbp band by PCR with these primers indicates the occurrence of the desired integration event at the pdc locus.

Template DNA for the PCRs was prepared by resuspending a small amount of yeast in 10 µL of water. Forty µL of Y-lysis buffer (Zymo Research Corp.) and 2 µL of Zymolyase (Zymo Research Corp.) were then added and the resuspended yeast cells were incubated at 37° C. for 30 minutes. The tubes were then shifted to 4° C. until PCR.

The PCRs (25 µL) were composed of 1 µL of template DNA (as described above) for the strain to be screened, 1× LongAmp® Taq Reaction Buffer (New England Biolabs, Inc.), 0.4 µM of the sense primer, 0.4 µM of the anti-sense primer, 300 µM each of dATP, dCTP, dGTP, and dTTP, and 2.5 units of LongAmp® Taq DNA polymerase (New England Biolabs, Inc.). The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 6 minutes and 45 seconds, with a final extension at 65° C. for 10 minutes. Following thermocycling, the PCR products were separated by 0.9% agarose gel electrophoresis in TBE buffer and the sizes of the bands visualized and interpreted as described above. Two independently isolated transformants having the desired bands were designated *I. orientalis* yMhCt184 and yMhCt185. The transformant genotypes for *I. orientalis* yMhCt184 and yMhCt185 are shown in Table 11.

TABLE 11

| Strain | Parent strain | Genotype |
|---|---|---|
| yMhCt184 | *I. orientalis* | pdcΔ::(PDC$_{promo}$-DpADC r2, |
| yMhCt185 | CNB1 | PDC$_{promo}$-DpADC r3, URA3, |
| | | TDH3$_{promo}$-DpADC r4, |
| | | TDH3$_{promo}$-DpADC r5)/PDC |

Example 9: Construction of Yeast Strains Expressing a Heterologous Insect Aspartate 1-Decarboxylase from *Apis mellifera* at the Pdc Locus This Example describes the construction of yeast cells containing four copies of polynucleotides encoding the *Apis mellifera* ADC of SEQ ID NO: 181 (codon-optimized coding sequences of SEQ ID NOs: 219, 220, 221, and 222) at the pdc locus with two copies under control of the *I. orientalis* PDC promoter and two copies under the control of the *I. orientalis* TDH3 promoter. A left-hand construct and a right-hand construct were designed to allow homologous recombination at the *I. orientalis* CNB1 pdc locus. To prevent recombination from occurring between the multiple copies of the nucleotide sequences encoding the same ADC sequence, four distinct nucleotide sequences codon-optimized for expression in *I. orientalis* were designed to encode the same ADC sequence.

Construction of a Left-Hand Fragment

The first cloning step for the left-hand construct was to replace the 5' *Aedes aegypti* ADC coding sequence in pMBin249 (Example 10) with the *Apis mellifera* ADC coding sequence r2 (AmADC r2; SEQ ID NO: 219 which encodes the ADC of SEQ ID NO: 181) codon-optimized for expression in *I. orientalis* and synthesized by GeneArt® in the plasmid pMK-RQ. The AmADC r2 plasmid was digested with NheI and AscI and the resulting fragments were separated by 0.9% agarose gel electrophoresis in TAE buffer where an approximately 1.6 kbp band was excised from the gel and purified using a NUCLEOSPIN® Extract II Kit according to the manufacturer's instructions. Plasmid pMBin249 was digested with NheI-HF and AscI and the resulting fragments were separated by 0.9% agarose gel electrophoresis in TAE buffer where an approximately 7.5 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 0.5 µl of the NheI/AscI pMBin249 fragment, 5 µl of the NheI/AscI AmADC r2 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r2 fragment by EcoRI and BglII digestion. One transformant was identified as containing the proper insertion of the desired r2 fragment and the plasmid was designated pMHCT234.

The next cloning step for the left construct was to remove the remaining *Aedes aegypti* ADC coding sequence and replace it with another *Apis mellifera* ADC coding sequence. The *Apis mellifera* ADC coding sequence r9 (AmADC r9; SEQ ID NO: 220 which encodes the ADC of SEQ ID NO: 181) codon-optimized for expression in *I. orientalis* was synthesized by GeneArt® in the plasmid pMK-RQ. The AmADC r9 plasmid was digested with SpeI and the resulting fragments were separated by 0.9% agarose gel electrophoresis in TAE buffer where an approximately 1.6 kbp band was excised from the gel and purified using a NUCLEOSPIN® Extract II Kit according to the manufacturer's instructions. Plasmid pMHCT234 was digested with SpeI.

The 5"-phosphate groups were removed by addition of 1 µl of calf intestinal phosphate enzyme (New England Biolabs, Inc.) and incubation at 37° C. for 20 minutes. The resulting fragments were separated by 0.9% agarose gel electrophoresis in TAE buffer where an approximately 7.4 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 2 µl of the SpeI pMHCT234 fragment, 2 µl of the SpeI AmADC r9 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r9 fragment by HpaI digestion. One transformant was identified as containing the proper insertion of the desired r9 fragment and the plasmid was designated pMHCT240.

Figure 15:
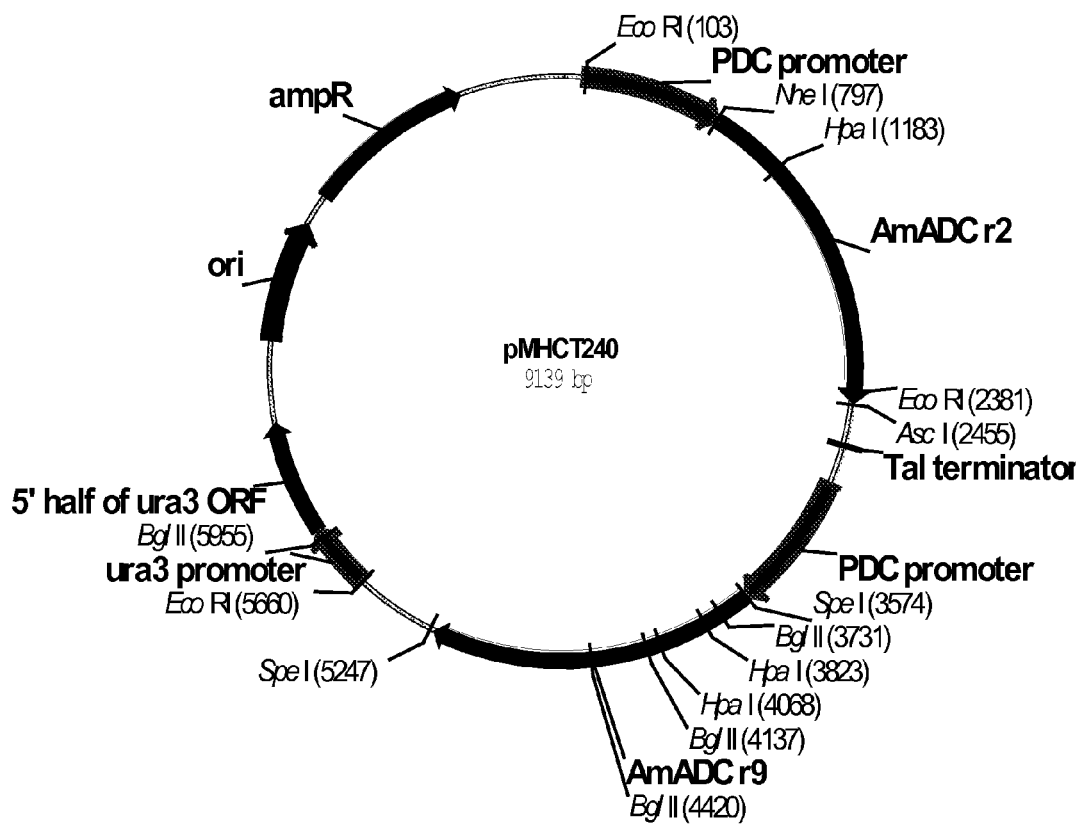
FIG. 15 shows a plasmid map for pMHCT240.

Plasmid pMHCT240 (FIG. 15) is a left-hand *I. orientalis* PDC targeting construct containing the *I. orientalis* PDC promoter driving expression of the *Apis mellifera* ADC r2 coding sequence (SEQ ID NO: 219) codon-optimized for expression in *I. orientalis*, the *I. orientalis* TAL terminator, the *I. orientalis* PDC promoter driving expression of the second *Apis mellifera* ADC r9 coding sequence (SEQ ID NO: 220) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

The first cloning step for the right-hand construct was to replace the 3' *Aedes aegypti* ADC coding sequence in pMBin250 (Example 10) with the *Apis mellifera* ADC coding sequence r7 (AmADC r7; SEQ ID NO: 221 which encodes the ADC of SEQ ID NO: 181) codon-optimized for expression in *I. orientalis* and synthesized by GeneArt® in the plasmid pMK-RQ. The AmADC r7 plasmid was digested with XbaI and PacI and the resulting fragments were separated by 0.9% agarose gel electrophoresis in TAE buffer where an approximately 1.6 kbp band was excised from the gel and purified using a NUCLEOSPIN® Extract II Kit according to the manufacturer's instructions. Plasmid pMBin250 (Example 10) was digested with XbaI and PacI and the resulting fragments were separated by 0.9% agarose gel electrophoresis in TAE buffer where an approximately 8.8 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 0.5 µl of the XbaI/PacI pMBin250 fragment, 5 µl of the XbaI/PacI AmADC r7 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r7 fragment by EcoRI and BglII digestion. One transformant was identified as containing the proper insertion of the desired r7 fragment and the plasmid was designated pMHCT236.

The next cloning step for the right construct was to remove the remaining *Aedes aegypti* ADC coding sequence and replace it with another *Apis mellifera* ADC coding sequence. The *Apis mellifera* ADC coding sequence r10 (AmADC r10; SEQ ID NO: 222 which encodes the ADC of SEQ ID NO: 181) codon-optimized for expression in *I. orientalis* was synthesized by GeneArt® in the plasmid pMK-RQ. The AmADC r10 plasmid was digested with NheI and AscI and the resulting fragments were separated by 0.9% agarose gel electrophoresis in TAE buffer where an approximately 1.6 kbp band was excised from the gel and purified using a NUCLEOSPIN® Extract II Kit according to the manufacturer's instructions. Plasmid pMHCT236 was digested with NheI and AscI and the resulting fragments were separated by 0.9% agarose gel electrophoresis in TAE buffer where an approximately 8.7 kbp band was excised from the gel and purified using a NUCLEOSPIN® Extract II Kit according to the manufacturer's instructions. The purified fragments described above were joined together in a ligation reaction (20 µl) composed of 1× Quick ligation buffer, 2 µl of the NheI/AscI pMHCT236 fragment, 5 µl of the NheI/AscI AmADC r10 insert, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired r10 fragment by BglII digestion. One transformant was identified as containing the proper insertion of the desired r10 fragment and the plasmid was designated pMHCT241.

Figure 16:
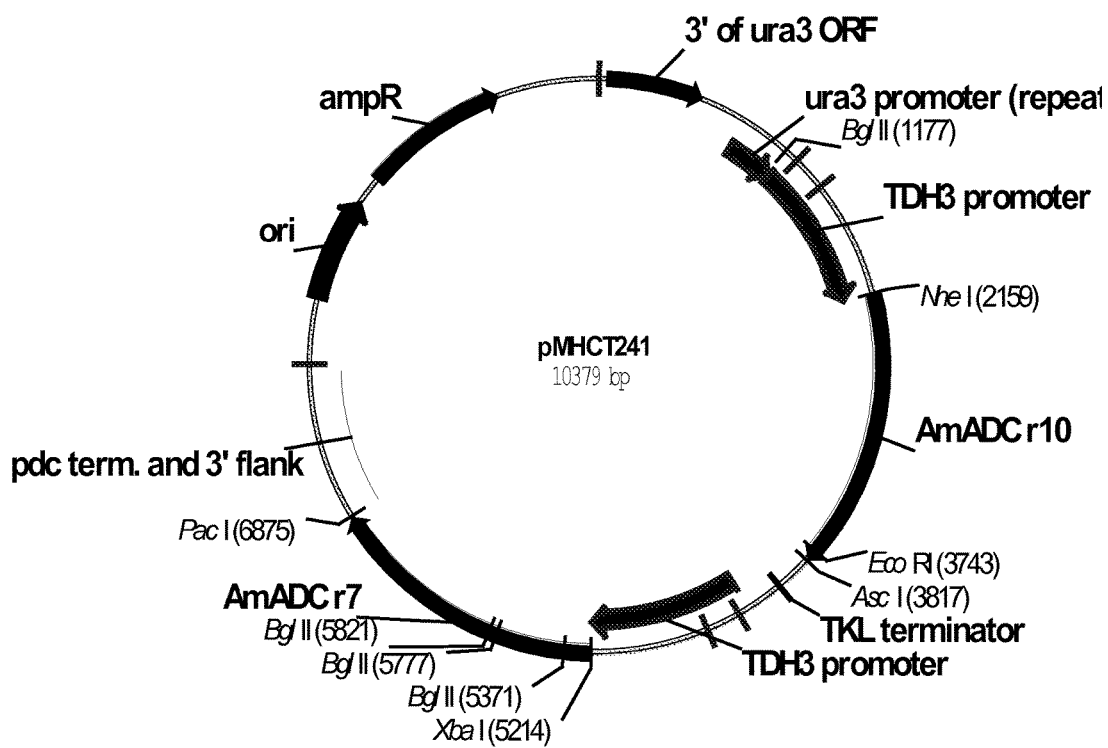
FIG. 16 shows a plasmid map for pMHCT241.

Plasmid pMHCT241 (FIG. 16) is a right-hand *I. orientalis* PDC targeting construct containing the 3' fragment of the *I. orientalis* URA3 ORF, the *I. orientalis* URA3 promoter, the *I. orientalis* TDH3 promoter driving expression of the *Apis mellifera* ADC r10 coding sequence (SEQ ID NO: 222) codon-optimized for expression in *I. orientalis*, the *I. orientalis* TKL terminator, the *I. orientalis* TDH3 promoter driving expression of the second *Apis mellifera* ADC r7 coding sequence (SEQ ID NO: 221) codon-optimized for expression in *I. orientalis*, and the *I. orientalis* PDC terminator.

Integration of the Left-Hand and Right-Hand Fragments

The Examples above describe creation of left-hand and right-hand constructs for targeting expression of four nucleotide variants of the *Apis mellifera* ADC gene codon-optimized for expression in *I. orientalis* at the pdc locus. Prior to transformation into *I. orientalis*, 30 µg of pMHCT240 were digested with NotI to release the desired transforming DNA from the pUC19 backbone vector. Likewise, 30 µg of pMHCT241 were digested with NotI to release the desired transforming DNA from the pUC19 backbone vector. For pMHCT240, an approximately 6.5 kbp containing band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. For pMHCT241, an approximately 7.7 kbp band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. Then 613 ng of the NotI pMHCT240 fragment and 532 ng of the NotI pMHCT241 fragment were used to transform *I. orientalis* CNB1 as described in Example 1.

Transformants were selected on SD ura– plates incubated at 37° C. for growth. Eighteen transformants were picked the following day and restreaked for single colonies on SD ura– plates and grown at 37° C. overnight. Then a single colony was picked from each of the streaks generated by each initial transformant and restreaked on SD ura– plates.

Following the round of single colony purification and outgrowth, PCRs were performed to verify the desired targeted integration occurred as described herein. Correct targeting of the pMHCT240 and pMHCT241 fragments to the adh2556 locus was verified using primers 0615988 and 0611245 as well as primers 0612908 and 0615989. Primer 0615988 binds to the pdc locus 5' of the region targeted, while primer 0611245 binds to the RKI terminator and amplifies in the anti-sense direction. Generation of an approximately 5.6 kbp band by PCR with these primers indicates the occurrence of the desired integration event at the pdc locus. Primer 0612908 binds in the URA3 coding region, while primer 0615989 binds in the pdc locus 3' of the region targeted and amplifies in the anti-sense direction. Generation of an approximately 7.5 kbp band by PCR with these primers indicates the occurrence of the desired integration event at the pdc locus.

Template DNA for the PCRs was prepared by resuspending a small amount of yeast in 10 µL of water. Forty µL of Y-lysis buffer and 2 µL of Zymolyase were then added and the resuspended yeast cells were incubated at 37° C. for 30 minutes. The tubes were then shifted to 4° C. until PCR.

The PCRs (25 µL) were composed of 1 µL of template DNA (as described above) for the strain to be screened, 1× LongAmp® Taq Reaction Buffer, 0.4 µM of the sense primer, 0.4 µM of the anti-sense primer, 300 µM each of dATP, dCTP, dGTP, and dTTP, and 2.5 units of LongAmp® Taq DNA polymerase. The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 6 minutes and 45 seconds, with a final extension at 65° C. for 10 minutes. Following thermocycling, the PCR products were separated by 0.9% agarose gel electrophoresis in TBE buffer and the sizes of the bands visualized and interpreted as described above. Two independently isolated transformants having the desired bands were designated *I. orientalis* yMhCt186 and yMhCt187. The transformant genotypes for *I. orientalis* yMhCt186 and yMhCt187 are shown in Table 12.

TABLE 12

| Strain | Parent strain | Genotype |
|---|---|---|
| yMhCt186 | *I. orientalis* | pdcΔ::(PDC$_{promo}$-AmADC r2, |
| yMhCt187 | CNB1 | PDC$_{promo}$-AmADC r9, URA3, |
| | | TDH3$_{promo}$-AmADC r10, |
| | | TDH3$_{promo}$-AmADC r7)/PDC |
| | | r7)/PDC |

Example 10: Construction of Yeast Strains Expressing a Heterologous Insect Aspartate 1-Decarboxylase from *Aedes aegypti* at the Pdc Locus This Example describes the construction of yeast cells containing four copies of polynucleotides encoding the *Aedes aegypti* ADC of SEQ ID NO: 162 (codon-optimized coding sequences of SEQ ID NOs: 158, 159, 160, and 161) at the pdc locus with two copies under control of the *I. orientalis* PDC promoter and two copies under the control of the *I. orientalis* TDH3 promoter.

Construction of a Left-Hand Fragment

Plasmid pMeJi363 (Example 2) was digested with NheI and PacI and separated by 1% agarose gel electrophoresis in TAE buffer. A band of approximately 4.5 kbp was excised from the gel and purified using a QIAQUICK® Gel Extraction Kit according to the manufacturer's instructions. This fragment contains ADCr3 and ADCr4, each driven by the *I. orientalis* PDC promoter, and the 5' portion of the URA3 selectable marker. The PDC targeting plasmid pMHCT111 (Example 7) was digested with NheI and PacI and separated by 1% agarose gel electrophoresis in TAE buffer. A band of approximately 4.7 kbp was excised from the gel and purified using a QIAQUICK® Gel Extraction Kit according to the manufacturer's instructions. This fragment contains the vector backbone, as well as, the 5' region of homology to the pdc locus. The 4.5 kbp NheI/PacI insert containing the two ADC coding sequences was ligated to the 4.7 kbp NheI/PacI pMHCT111 fragment in a total reaction volume of 10 µL composed of 2 µL of the NheI/PacI pMHCT111 fragment, 6 µL of the 4.5 kbp NheI/PacI insert, 1 µL of 10× ligation buffer with 10 mM ATP, and 1 µL of T4 ligase. The reaction was incubated for 18 hours at 22° C. and a 4 µL aliquot of the reaction was transformed into ONE SHOT® TOP10 chemically competent *E. coli* cells according to manufacturer's instructions. After a recovery period, two 100 µL aliquots from the transformation reaction were spread onto 150 mm 2×YT+amp plates. The plates were incubated overnight at 37° C. Putative recombinant clones were selected from the selection plates and plasmid DNA was prepared from each one using a BIOROBOT® 9600. Clones were analyzed by restriction digestion with NcoI plus HindIII and a plasmid with the correct restriction digestion pattern was designated plasmid pMBin249.

Figure 17:
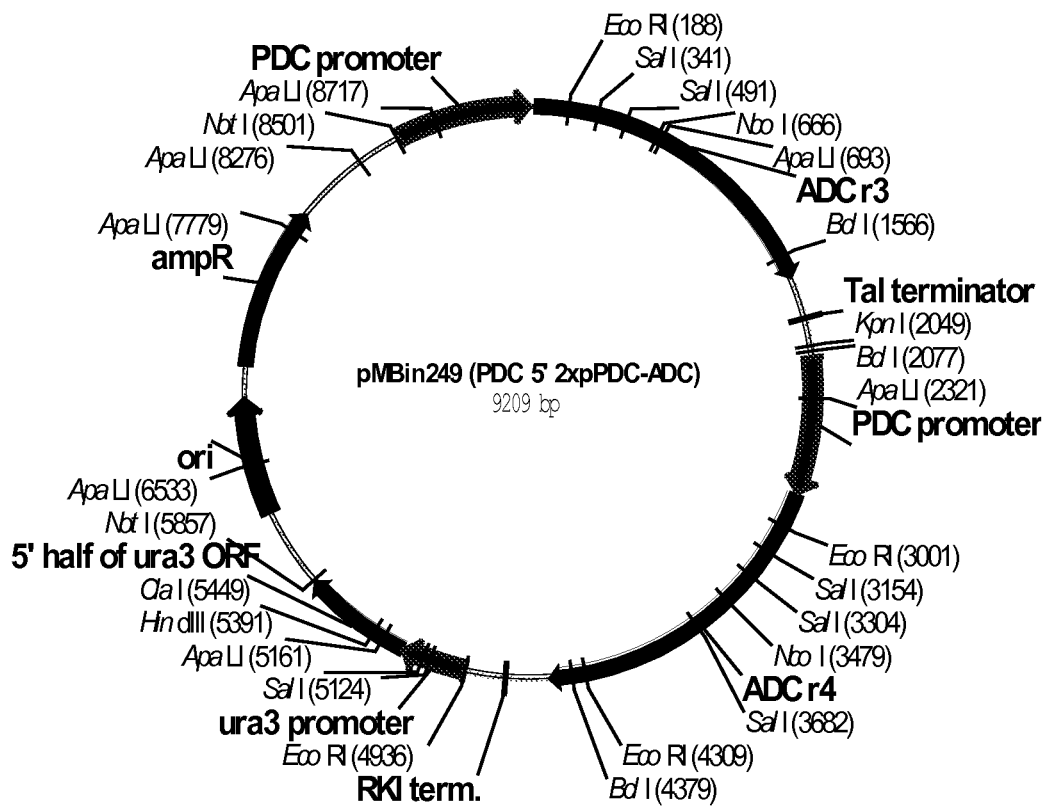
FIG. 17 shows a plasmid map for pMBin249.

Plasmid pMBin249 (FIG. 17) is a left-hand *I. orientalis* pdc targeting construct containing the *I. orientalis* PDC promoter driving expression of the *A. aegypti* ADC r3 coding sequence (SEQ ID NO: 160) codon-optimized for expression in *I. orientalis*, the *I. orientalis* TAL terminator, the *I. orientalis* PDC promoter driving expression of the second *A. aegypti* ADC r4 coding sequence (SEQ ID NO: 161) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

Plasmid pMeJi364 (Example 2) was digested with NheI, PacI, and ScaI (cuts in vector backbone), and separated by 1% agarose gel electrophoresis in TAE buffer. A band of approximately 4.8 kbp was excised from the gel and purified using a QIAQUICK® Gel Extraction Kit according to the manufacturer's instructions. This fragment contains the *A. aegypti* ADCr10 and ADC coding sequences, each driven by the *I. orientalis* CNB1 PDC promoter, and the 5' portion of the URA3 selectable marker. The PDC targeting plasmid pMHCT112 (Example 7) was digested with NheI and PacI and separated by 1% agarose gel electrophoresis in TAE buffer. A band of approximately 4.8 kbp was excised from the gel and purified using a QIAQUICK® Gel Extraction Kit according to the manufacturer's instructions. This fragment contains the vector backbone as well as the 3' region of homology to the pdc locus. The 4.8 kbp NheI/PacI fragment containing the two ADC coding sequences was ligated to the 4.8 kbp pMHCT112 linearized vector in a total reaction volume of 10 µL composed of 1 µL of the 4.8 kbp vector, 7 µL of the 4.8 kbp insert, 1 µL of 10× ligation buffer with 10 mM ATP, and 1 µL of T4 ligase. The reaction was incubated for 18 hours at 22° C. and a 4 µL aliquot of the reaction was transformed into ONE SHOT® TOP10 chemically competent E. coli cells according to manufacturer's instructions. After a recovery period, two 100 µL aliquots from the transformation reaction were spread onto 2×YT plates supplemented with 100 µg of ampicillin per ml. The plates were incubated overnight at 37° C. Putative recombinant clones were selected from the plates and plasmid DNA was prepared from each one using a BIOROBOT® 9600. Clones were analyzed by restriction digestion with ApaI plus PacI and a plasmid with the correct restriction digestion pattern was designated plasmid pMBin250.

Figure 18:
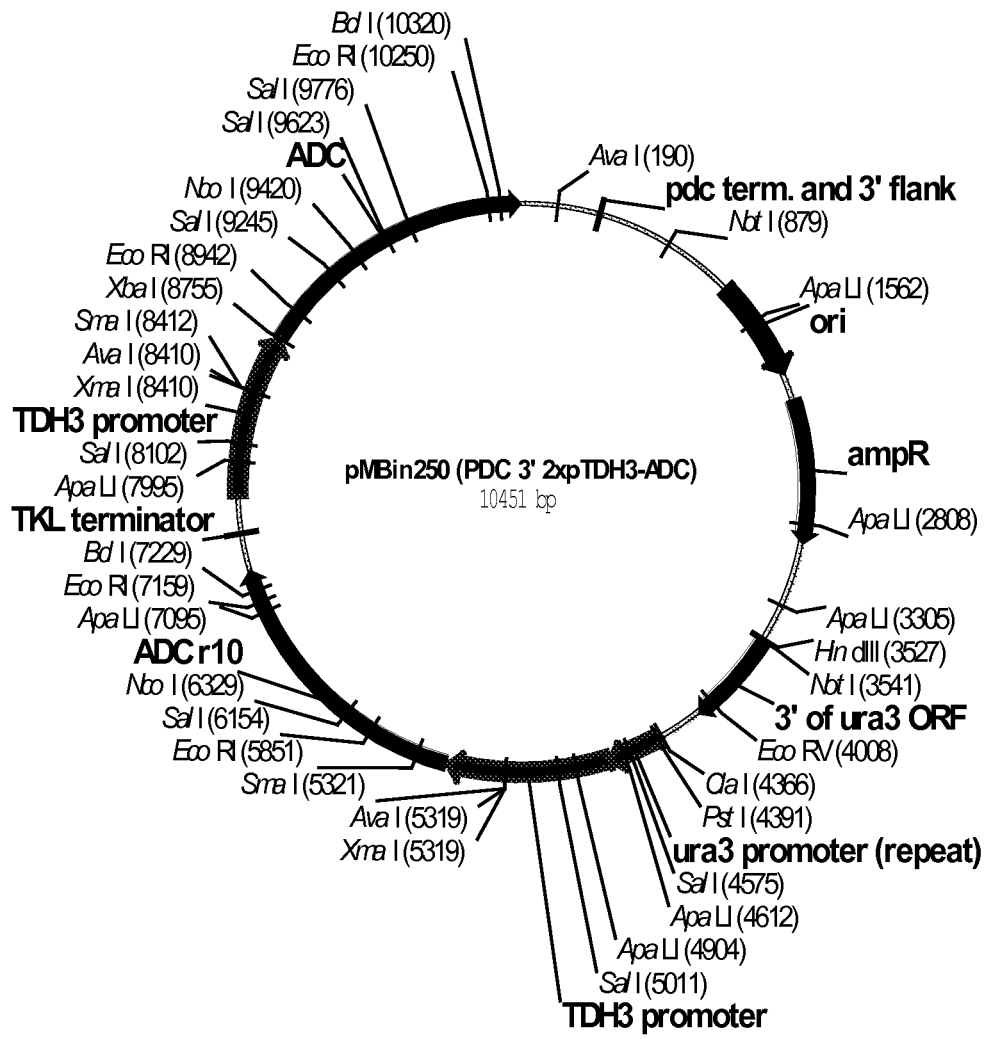
FIG. 18 shows a plasmid map for pMBin250.

Plasmid pMBin250 (FIG. 18) is a right-hand I. orientalis pdc targeting construct containing the 3' fragment of the I. orientalis URA3 ORF, the I. orientalis URA3 promoter, the I. orientalis TDH3 promoter driving expression of the A. aegypti ADC r10 coding sequence (SEQ ID NO: 159) codon-optimized for expression in I. orientalis, the I. orientalis TKL terminator, the I. orientalis TDH3 promoter driving expression of the second A. aegypti ADC coding sequence (SEQ ID NO: 158) codon-optimized for expression in I. orientalis, and the I. orientalis PDC terminator.

Integration of the Left-Hand and Right-Hand Fragments

Plasmid pMBin249 was digested with NotI and plasmid pMBin250 was digested with ApaI and KasI. The digested plasmids were separated by 1% agarose gel electrophoresis in TBE buffer where bands of approximately 6.6 kbp (from pMBin249) and 7.9 kbp (from pMBin250) were excised from the gels and purified using a QIAQUICK® Gel Extraction Kit according to the manufacturer's instructions.

I. orientalis CNB1 was transformed with the NotI pMBin249 fragment and the ApaI/KasI pMBin250 fragment as described in Example 1 and correct loci targeting and transformation were verified by using a Phire® Plant Direct PCR Kit according to the manufacturer's instructions. Primers 0615988 and 0611245 yield a band of approximately 5.4 kbp, and primers 0615989 and 0611317 yield a band of approximately 7.9 kbp. Transformants having the expected bands for proper integration of the expression cassette were designated I. orientalis MBin612 and MBin613. The transformant genotype for I. orientalis MBin612 and MBin613 is shown in Table 13.

TABLE 13

| Strain | Parent strain | Genotype |
|---|---|---|
| MBin612 | I. orientalis CNB1 | pdcΔ::(PDC$_{promo}$-AaADC r3, |
| MBin613 | | PDC$_{promo}$-AaADC r4, URA3, |
| | | TDH3$_{promo}$-AaADC r10, TDH3$_{promo}$- |
| | | AaADC)/PDC |

Example 11: Construction of Yeast Strains Expressing a Heterologous Insect Aspartate 1-Decarboxylase from Drosophila melanogaster at the Pdc Locus This Example describes the construction of yeast cells containing four copies of polynucleotides encoding the Drosophila melanogaster ADC of SEQ ID NO: 169 (codon-optimized coding sequences of SEQ ID NOs: 223, 224, 225, and 226) at the pdc locus with two copies under control of the I. orientalis PDC promoter and two copies under the control of the I. orientalis TDH3 promoter.

Construction of a Left-Hand Fragment

The first cloning step for the left-hand construct was to replace the 5' Aedes aegypti ADC coding sequence in pMBin250 (Example 10) with a Drosophila melanogaster ADC coding sequence ADCr2 (SEQ ID NO: 223 which encodes the ADC of SEQ ID NO: 169) codon-optimized for expression in I. orientalis and synthesized by GeneArt® in the plasmid p13AAZDUP_1363232_DmADCr2. Plasmid pMBin249 was digested with NheI and AscI and the digestion was purified by 0.7% agarose gel electrophoresis in TBE buffer. A band at approximately 7.5 kbp was excised from the gel and purified using a NucleoSpin® Gel Extraction Kit (Macherey-Nagel Inc.) according to the manufacturer's instructions. Plasmid 13AAZDUP_1363232_DmADCr2 was digested with NheI, AscI, and BspHI and the digestion was purified by 0.7% agarose gel electrophoresis in TBE buffer. A band at approximately 1.74 kbp, containing the Drosophila melanogaster ADCr2, was excised from the gel and purified using a NucleoSpin® Gel Extraction Kit according to the manufacturer's instructions.

The 7.5 kbp purified fragment of pMBin249 was ligated to the 1.74 kbp DmADCr2 fragment in a total reaction volume of 20 µL composed of 1 µL of the 7.5 kbp pMBin249 fragment, 5 µL of the 1.74 kbp DmADCr2 fragment, 2 µL of 10× ligation buffer with 10 mM ATP, and 1 µL of T4 ligase. The reaction was incubated for 1 hour at room temperature and a 10 µL aliquot of the reaction was transformed into Stellar™ Competent Cells according to manufacturer's instructions. The transformation reaction was spread onto 2×YT+amp plates and incubated at 37° C. overnight. Several of the resulting transformants were screened for proper insertion by restriction digestion with KpnI. An isolated plasmid yielding the correct digested band sizes was designated plasmid pMcTs150.

Plasmid pMcTs150 contains one D. melanogaster ADC coding sequence and one A. aegypti ADC coding sequence each with the I. orientalis PDC promoter targeting the pdc locus. The A. aegypti ADC coding sequence was removed by digesting pMcTs150 with SpeI. A band at approximately 7.5 kbp was excised from the gel and purified using a NucleoSpin® Gel Extraction Kit according to the manufacturer's instructions.

The D. melanogaster ADC coding sequence ADCr4 (SEQ ID NO: 224 which encodes the ADC of SEQ ID NO: 169) codon-optimized for expression in I. orientalis was synthesized by GeneArt® in the plasmid p13AAZDTP_1363231_DmADCr4. Plasmid p13AAZDTP_1363231_DmADCr4 was digested with SpeI and BspHI and the digestion was purified by 0.7% agarose gel electrophoresis in TBE buffer. A band at approximately 1.75 kbp, containing the Drosophila melanogaster ADCr4, was excised from the gel and purified using a NucleoSpin® Gel Extraction Kit according to the manufacturer's instructions.

To generate a plasmid with two D. melanogaster ADC coding sequences under control of the I. orientalis PDC promoter, the 7.5 kbp pMcTs150 fragment was ligated to the 1.75 kbp DmADCr4 fragment in a total reaction volume of 20 µL composed of 1 µL of the 7.5 kbp pMcTs150 fragment, 10 µL of the 1.75 kbp DmADCr4 fragment, 2 µL of 10× ligation buffer with 10 mM ATP, and 1 µL of T4 ligase. The reaction was incubated for 1 hour at room temperature and a 10 µL aliquot of the reaction was transformed into Stellar™ Competent Cells according to manufacturer's instructions. The transformation reaction was spread onto 2×YT+amp plates and incubated at 37° C. overnight. Several of the resulting transformants were screened for proper insertion by restriction digestion with KpnI and PacI plus EcoRI. An isolated plasmid yielding the correct digested band sizes was designated plasmid pMcTs152.

Figure 19:
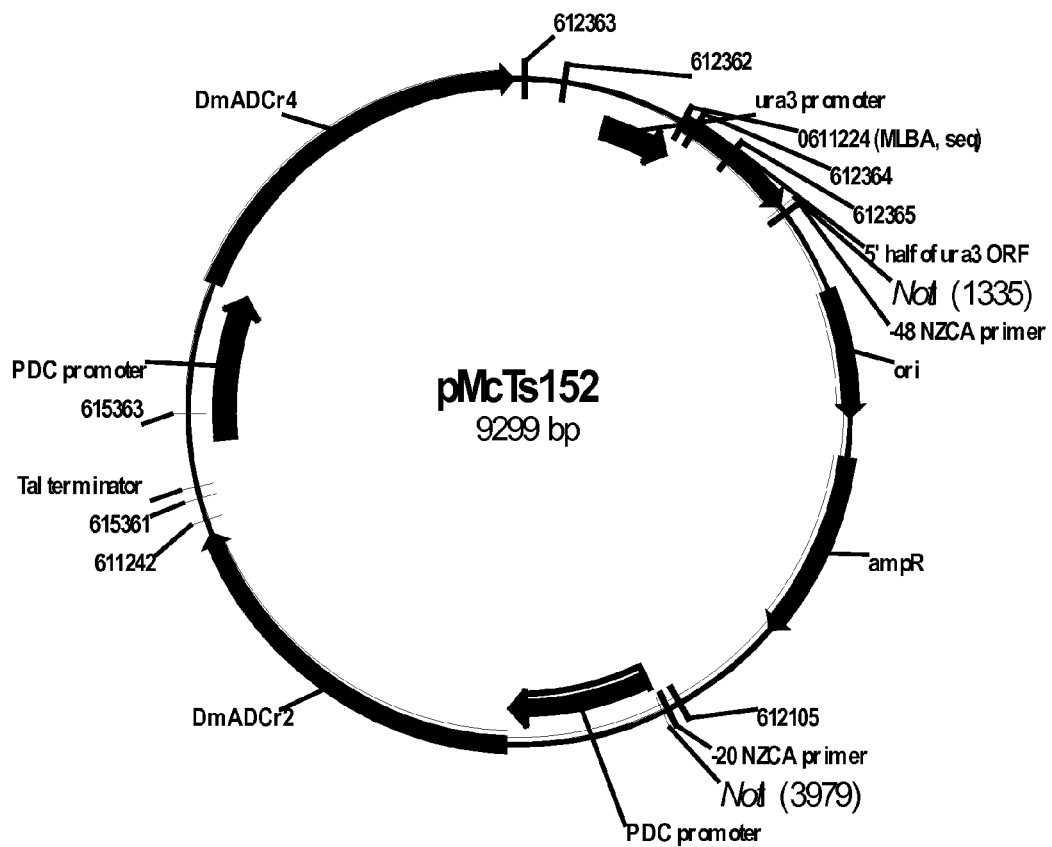
FIG. 19 shows a plasmid map for pMcTs152.

Plasmid pMcTs152 (FIG. 19) is a left-hand *I. orientalis* PDC targeting construct containing the *I. orientalis* PDC promoter driving expression of the *Drosophila melanogaster* ADC coding sequence ADCr2 (SEQ ID NO: 223) codon-optimized for expression in *I. orientalis*, the *I. orientalis* TAL terminator, the *I. orientalis* PDC promoter driving expression of the second *Drosophila melanogaster* ADC coding sequence ADCr4 (SEQ ID NO: 224) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

The first cloning step for the right-hand construct was to replace the 3' *Aedes aegypti* ADC coding sequence in pMBin249 (Example 10) with the *Drosophila melanogaster* ADC coding sequence ADCr8 (SEQ ID NO: 225 which encodes the ADC of SEQ ID NO: 169) codon-optimized for expression in *I. orientalis* and synthesized by GeneArt® in the plasmid p13AAZDRP_1363229_DmADCr8.

Plasmid pMBin250 (Example 10) was digested with NheI and AscI and the digested plasmid was purified by 0.7% agarose gel electrophoresis in TBE buffer. A band at approximately 8.76 kbp was excised from the gel and purified using a NucleoSpin® Gel Extraction Kit according to the manufacturer's instructions. Plasmid 13AAZDRP_1363229_DmADCr8 was digested with NheI, AscI, and BspHI and the digested plasmid was purified by 0.7% agarose gel electrophoresis in TBE buffer. A band at approximately 1.74 kbp, containing the *Drosophila melanogaster* ADCr8, was excised from the gel and purified using a NucleoSpin® Gel Extraction Kit according to the manufacturer's instructions.

The 8.76 kbp pMBin250 fragment of was ligated to the 1.74 kbp DmADCr8 fragment in a total reaction volume of 20 µL composed of 1 µL of the 7.5 kbp pMBin249 fragment, 10 µL of the 1.74 kbp DmADCr8 fragment, 2 µL of 10× ligation buffer with 10 mM ATP, and 1 µL of T4 ligase. The reaction was incubated for 1 hour at room temperature and a 10 µL aliquot of the reaction was transformed into Stellar™ Competent Cells according to manufacturer's instructions. The transformation reaction was spread onto 2×YT+ amp plates and incubated at 37° C. overnight. Several of the resulting transformants were screened for proper insertion by restriction digestion with KpnI plus SpeI and NotI plus PstI. An isolated plasmid yielding the correct digested band sizes was designated plasmid pMcTs148.

Plasmid pMcTs148 contains one *D. melanogaster* ADC coding sequence and one *A. aegypti* ADC coding sequence each with *I. orientalis* TDH3 promoter targeting the pdc locus. The *A. aegypti* ADC coding sequence was removed by digesting pMcTs148 with XbaI and PacI and then purifying the fragments by 0.7% agarose gel electrophoresis in TBE buffer. A band at approximately 8.8 kbp was excised from the gel and purified using a NucleoSpin® Gel Extraction Kit according to the manufacturer's instructions.

The *Drosophila melanogaster* ADC coding sequence ADCr6 (SEQ ID NO: 226 which encodes the ADC of SEQ ID NO: 169) codon-optimized for expression in *I. orientalis* was synthesized by GeneArt® in the plasmid p13AAZDSP_1363230_DmADCr6. Plasmid 13AAZDSP_1363230_DmADCr6 was digested with XbaI, PacI, and BspHI. A band at approximately 1.74 kbp, containing the *Drosophila melanogaster* ADC coding sequence ADCr6, was excised from the gel and purified using a NucleoSpin® Gel Extraction Kit according to the manufacturer's instructions.

To generate a plasmid with two *D. melanogaster* ADC coding sequences under control of the *I. orientalis* TDH3 promoter, the 8.8 kbp pMcTs148 fragment was ligated to the 1.74 kbp DmADCr6 fragment in a total reaction volume of 20 µL composed of 1 µL of the 7.5 kbp pMcTs150 fragment, 5 µL of the 1.74 kbp DmADCr6 fragment, 2 µL of 10× ligation buffer with 10 mM ATP, and 1 µL of T4 ligase. The reaction was incubated for 1 hour at room temperature and a 10 µL aliquot of the reaction was transformed into Stellar™ Competent Cells according to manufacturer's instructions. The transformation reaction was spread onto 2×YT+ amp plates and incubated at 37° C. overnight. Several of the resulting transformants were screened for proper insertion by restriction digestion with KpnI. An isolated plasmid yielding the correct digested band sizes was designated plasmid pMcTs149.

Figure 20:
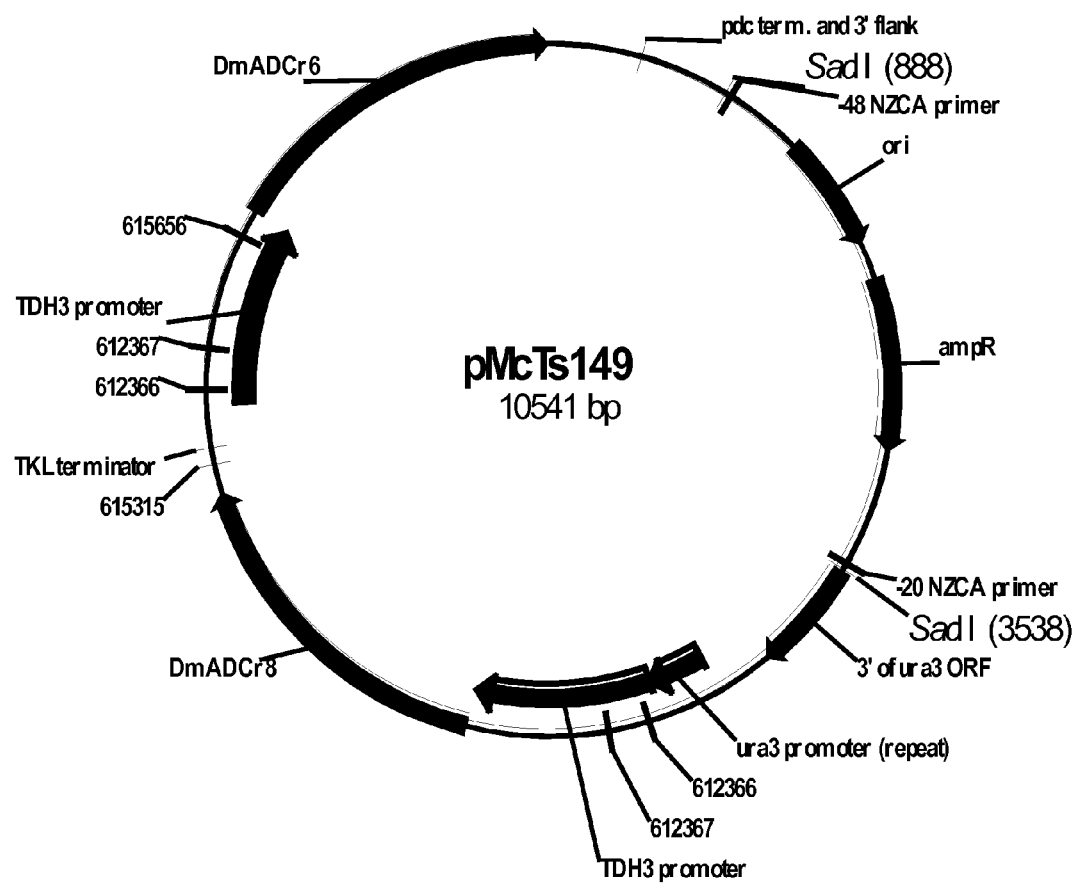
FIG. 20 shows a plasmid map for pMcTs149.

Plasmid pMcTs149 (FIG. 20) is a right-hand *I. orientalis* pdc targeting construct containing the 3' fragment of the *I. orientalis* URA3 ORF, the *I. orientalis* URA3 promoter, the *I. orientalis* TDH3 promoter driving expression of the *D. melanogaster* ADC coding sequence ADCr8 (SEQ ID NO: 225) codon-optimized for expression in *I. orientalis*, the *I. orientalis* TKL terminator, the *I. orientalis* TDH3 promoter driving expression of the second *D. melanogaster* ADC coding sequence ADCr6 (SEQ ID NO: 226) codon-optimized for expression in *I. orientalis*, and the *I. orientalis* PDC terminator.

Integration of the Left-Hand and Right-Hand Fragments

Plasmid pMcTs152 was digested with NotI and plasmid pMcTs149 was digested with NotI and SacII. The digestions were purified by 0.7% agarose gel electrophoresis in TBE buffer where bands of approximately 6.6 kbp (from pMcTs152) and 7.9 kbp (from pMcTs149) were excised from the gels and purified using a NucleoSpin® Gel Extraction Kit according to the manufacturer's instructions.

*I. orientalis* CNB1 was transformed with the digested pMcTs152 and pMcTs149 fragments as described in Example 1 and correct loci targeting and transformation were verified using a Phire® Plant Direct PCR Kit according to the manufacturer's instructions. Primers 0615988 and 0611245 yield a band of approximately 5.5 kbp, and primers 0615989 and 0612908 yield an approximately 7.6 kbp band. A strain which gave the expected bands for proper integration of the expression cassette was designated *I. orientalis* McTs510.

The transformant genotype for *I. orientalis* McTs510 is shown in Table 14.

TABLE 14

| Strain | Parent strain | Genotype |
| --- | --- | --- |
| McTs510 | *I. orientalis* CNB1 | pdcΔ::(PDC$_{promo}$-DmADC r2, PDC$_{promo}$-DmADC r4, URA3, TDH3$_{promo}$-DmADC r8, TDH3$_{promo}$-DmADC r6)/PDC |

Example 12: 3-HP Production in Recombinant Yeast Strains Expressing Different Heterologous Insect Aspartate 1-Decarboxylases This Example describes 3-HP production characteristics in yeast strains expressing four copies of polynucleotides encoding different insect ADCs at the same locus (pdc):

ADC *Aedes aegypti* (*I. orientalis* MBin612 and MBin613; both encoding the ADC of SEQ ID NO: 162), ADC *Drosophila melanogaster* (*I. orientalis* McTs510; encoding the ADC of SEQ ID NO: 169), or ADC *Danaus plexippus* (*I. orientalis* yMhCt184; encoding the ADC of SEQ ID NO: 170).

Figure 21:
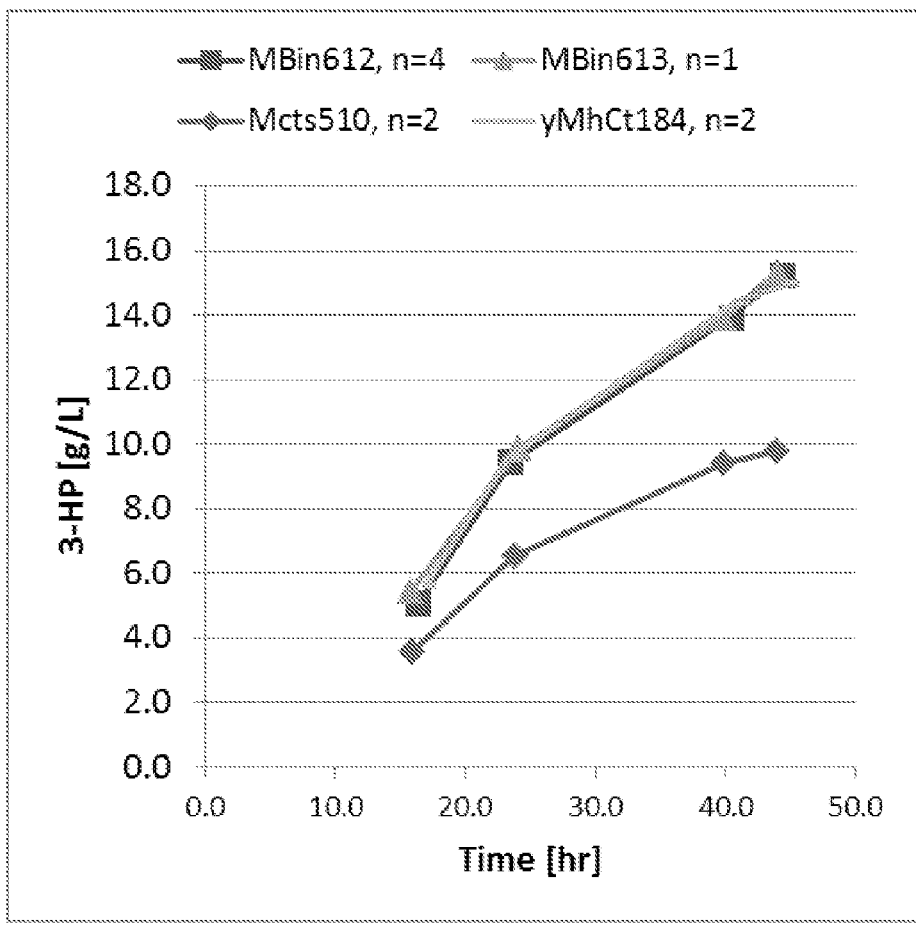
FIG. 21 shows a fermentation plot of 3-HP at various time points.

Cultivation medium and conditions as well as analytical methods were the same as in Example 5. The resulting fermentations of *I. orientalis* MBin612, MBin613, McTs510, and yMhCt184 are shown in FIG. 21 (3-HP concentration at various time points) and Table 15 (3HP concentration and yield after 44 hours of fermentations). *I. orientalis* MBin612, MBin613, and yMhCt184 performed similarly while *I. orientalis* McTs510 performed slightly lower. However all tested strains expressing the heterologous insect ADCs showed higher 3-HP concentration and yield compared to *I. orientalis* MIBa351 which expresses the *Bacillus licheniformis* ADC of SEQ ID NO: 139 (see Example 5).

TABLE 15

| Strain | Number of fermentations | Expressed ADC | [3-HP] (g/L) | 3-HP (yield) |
|---|---|---|---|---|
| MBin612 | 4 | SEQ ID NO: 162 | 15.2 | 7.6 |
| MBin613 | 1 | SEQ ID NO: 162 | 15.3 | 8.1 |
| McTs510 | 2 | SEQ ID NO: 169 | 9.8 | 4.3 |
| yMhCt184 | 2 | SEQ ID NO: 170 | 15.0 | 6.4 |

Example 13: Construction of a Yeast Strain Expressing a Heterologous *Aedes aegypti* Aspartate 1-Decarboxylase at the mdhB Locus This Example describes the construction of yeast cells containing two copies of polynucleotides encoding the *Aedes aegypti* ADC of SEQ ID NO: 162 (codon-optimized coding sequences of SEQ ID NOs: 161 and 158) at the mdhB locus with one copy under control of the *I. orientalis* PDC promoter and one copy under the control of the *I. orientalis* TDH3 promoter.

Construction of a Left-Hand Fragment

Figure 23:
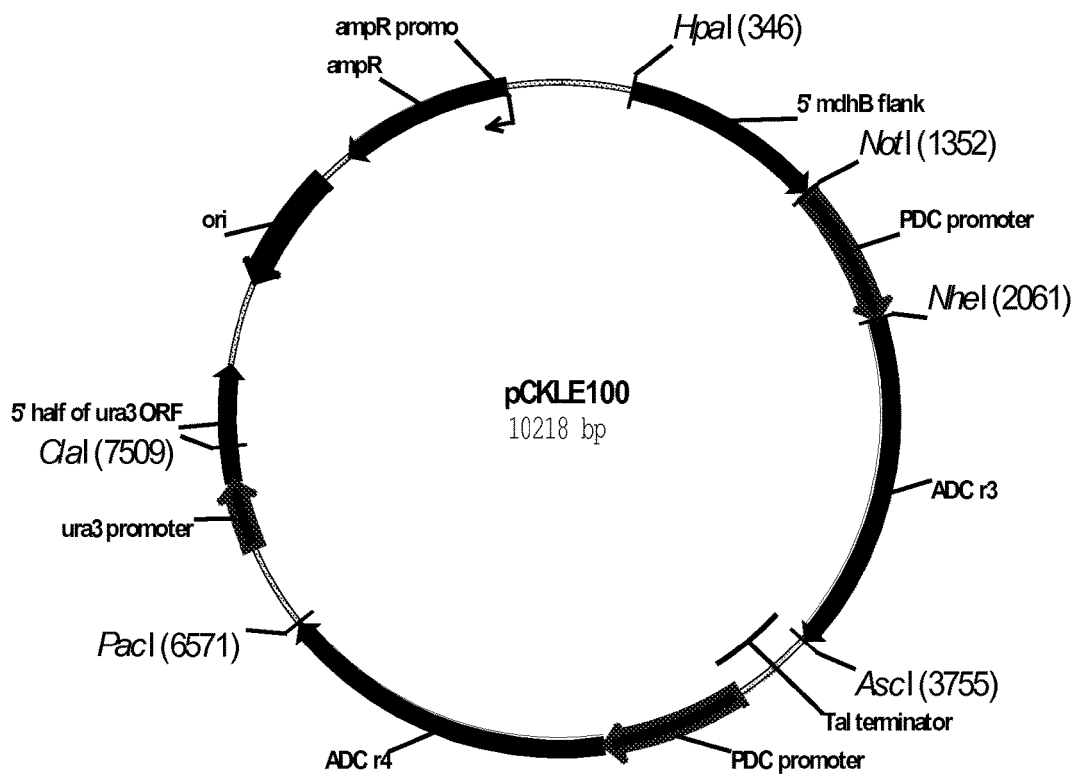
FIG. 23 shows a plasmid map of pCKLE100.

The plasmid pCKLE100 (FIG. 23) is analogous to pMeJi363 (Example 2) except that the left-hand adh2556 homology region between the HpaI and NotI restriction sites in pMeJi363 was replaced with homology to the malate dehydrogenase B (mdhB) locus (SEQ ID NO: 230).

Figure 24:
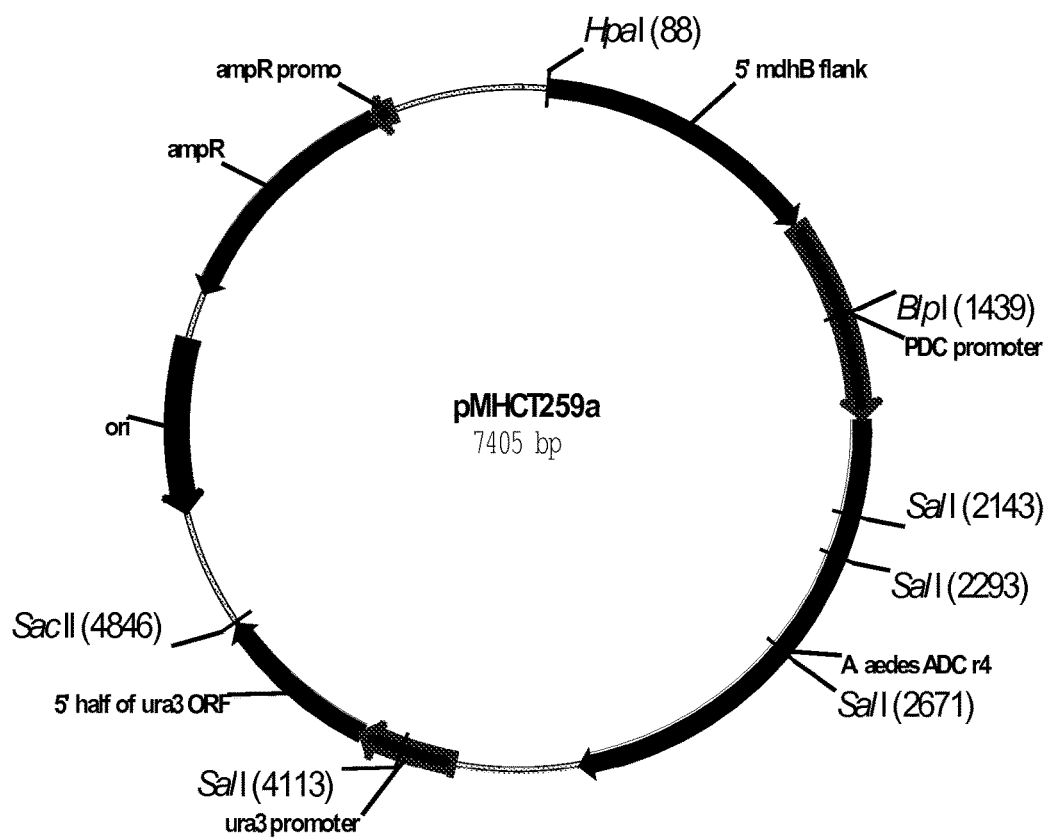

To create a left-hand plasmid with a single *Aedes aegypti* ADC coding sequence, pCKLE100 was digested with BlpI and the resulting fragments were separated by 0.9% agarose gel electrophoresis in TAE buffer where an approximately 7.4 kbp band was excised from the gel and purified using a NUCLEOSPIN® Extract II Kit according to the manufacturer's instructions. This purified fragment was ligated to itself in a ligation reaction (20 µl) composed of 1× Quick ligation buffer, 0.2 µl of the BlpI pCKLE100 fragment, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at room temperature for approximately 72 hours. Putative transformant colonies were isolated from the selection plates and plasmid DNA was prepared from each one using a BIOROBOT® 9600 and screened for proper re-ligation of pCKLE100 with the BlpI fragment removed by SalI digestion. One transformant was identified as containing the proper re-ligation of pCKLE100 and the plasmid was designated pMHCT259a (FIG. 24).

Plasmid pMHCT259a is a left-hand *I. orientalis* mdhB targeting construct containing the *I. orientalis* PDC promoter driving expression of the *A. aegypti* ADC r4 coding sequence (SEQ ID NO: 161) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

Figure 25:
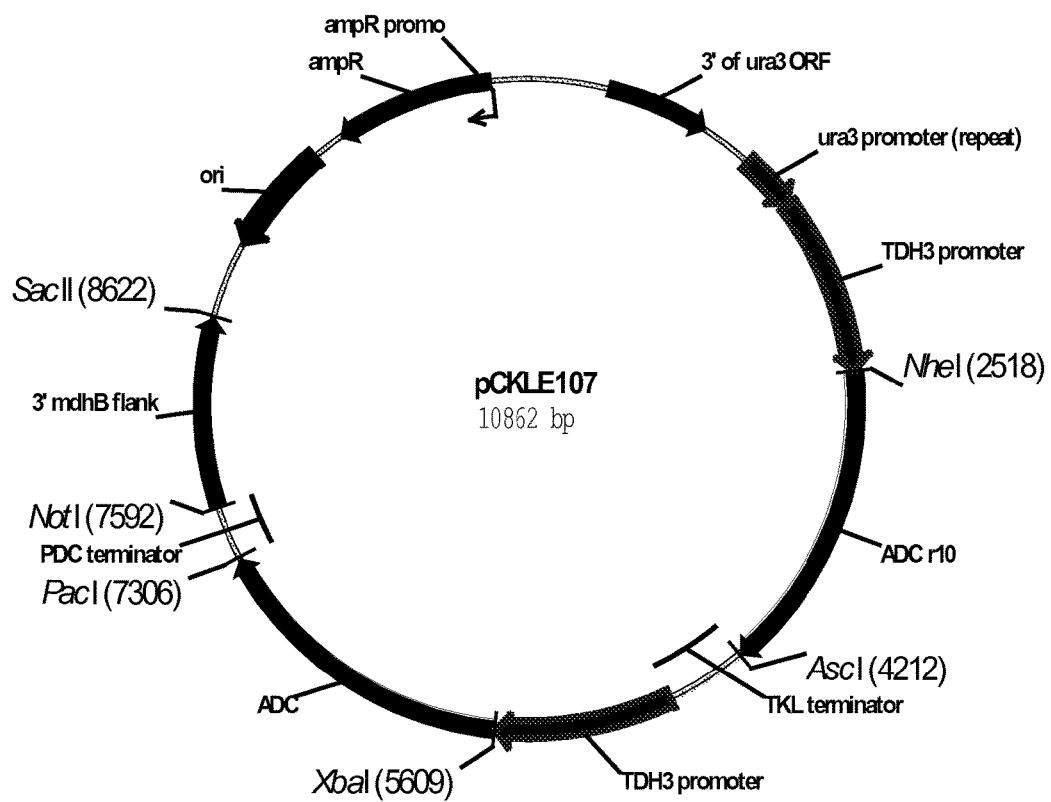
FIG. 25 shows a plasmid map of pCKLE107.

Plasmid pCKLE107 (FIG. 25) is analogous to pMeJi364 (Example 2) except that the right-hand adh2556 homology region between the NotI and SacII restriction sites in pMeJi364 was replaced with homology to the malate dehydrogenase B (mdhB locus (SEQ ID NO: 231).

Figure 26:
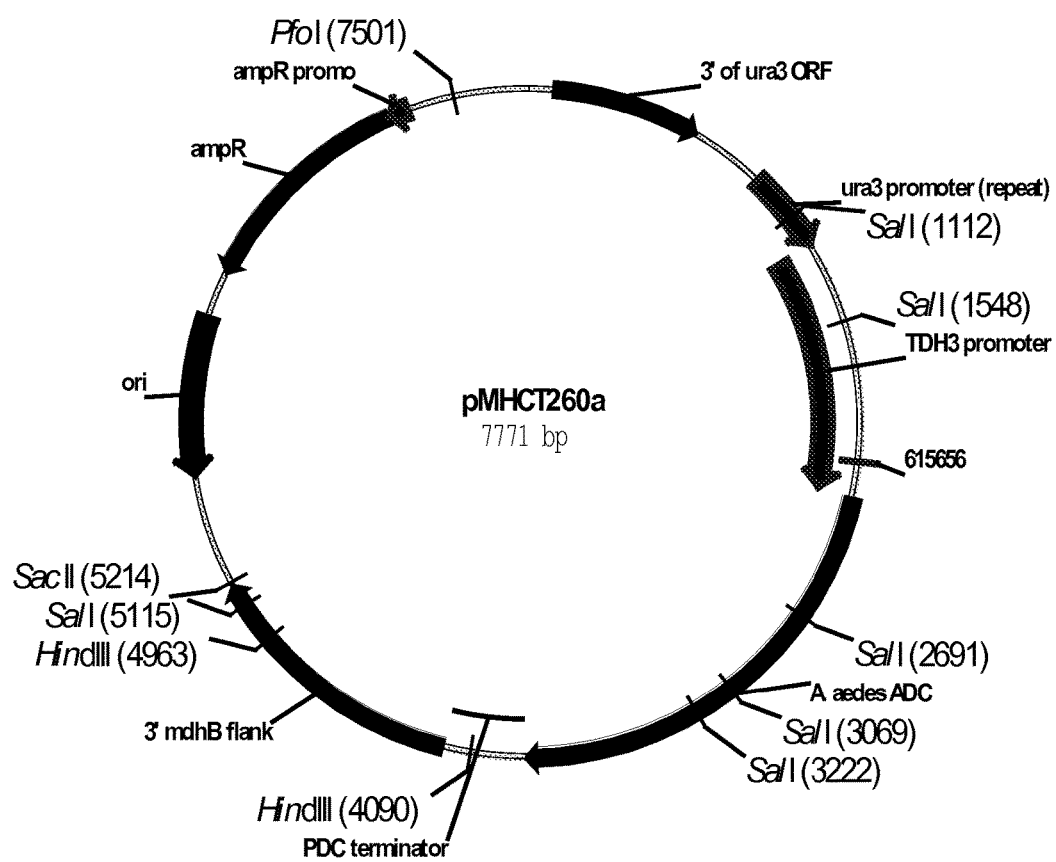

To create a right-hand plasmid with a single *Aedes aegypti* ADC coding sequence, pCKLE107 was digested with NheI and XbaI and the resulting fragments were separated by 0.9% agarose gel electrophoresis in TAE buffer where an approximately 7.8 kbp band was excised from the gel and purified using a NUCLEOSPIN® Extract II Kit according to the manufacturer's instructions. This purified fragment was ligated to itself in a ligation reaction (20 µl) composed of 1× Quick ligation buffer, 0.5 µl of the NheI/XbaI pCKLE107 fragment, and 1 µl of Quick T4 DNA ligase. The ligation reaction was incubated at room temperature for 5 minutes, and then cooled on ice. Five µl of the reaction were used to transform Stellar™ Competent Cells according to the manufacturer's instructions. The transformation reaction was spread onto 2×YT+amp plates and incubated at room temperature for approximately 72 hours. Putative transformant colonies were isolated from the selection plates and plasmid DNA was prepared from each one using a BIOROBOT® 9600 and screened for proper re-ligation of pCKLE107 with the NheI and XbaI fragment removed using a SalI and HindIII double digestion. One transformant was identified as containing the proper re-ligation of pCKLE107 and the plasmid was designated pMHCT260a (FIG. 26).

Plasmid pMHCT260a is a right-hand *I. orientalis* adh2556 targeting construct containing the 3' fragment of the *I. orientalis* URA3 ORF, the *I. orientalis* URA3 promoter, the *I. orientalis* TDH3 promoter driving expression of the *A. aegypti* ADC coding sequence (SEQ ID NO: 158) codon-optimized for expression in *I. orientalis*, and the *I. orientalis* PDC terminator.

Integration of the Left-Hand and Right-Hand Fragments

The Examples above describe creation of left-hand and right-hand constructs for targeting expression of two nucleotide variants of the *A. aegypti* ADC gene codon-optimized for expression in *I. orientalis* at the mdhB locus. Prior to transformation into *I. orientalis*, 30 µg of pMHCT259a were digested with HpaI and SacII to release the desired transforming DNA from the pUC19 backbone vector. Likewise, 30 µg of pMHCT260a were digested with PfoI and SacII to release the desired transforming DNA from the pUC19 backbone vector. For pMHCT259a, an approximately 4.8 kbp containing band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. For pMHCT260a, an approximately 5.5 kbp band (containing the desired expression cassette) was separated from the vector DNA by 0.9% agarose gel electrophoresis in TAE buffer, excised from the gel, and purified using a NUCLEO-SPIN® Extract II Kit according to the manufacturer's instructions. Then approximately 800 ng of the HpaI/SacII pMHCT259a fragment and approximately 800 ng of the PfoI/SacII pMHCT260a fragment were used to transform *I. orientalis* CNB1 as described in Example 1.

Transformants were selected on SD ura– plates at 37° C. Six transformants were picked the following day and restreaked for single colonies on SD ura– plates and grown at 37° C. overnight. Then a single colony was picked from each of the streaks generated by each initial transformant and restreaked on SD ura– plates.

Following the round of single colony purification and outgrowth, PCRs were performed to verify the desired targeted integration occurred as described herein. Correct targeting of the pMHCT259a and pMHCT260a fragments to the mdhB locus was verified using primers 1206368 and 0613109 as well as primers 0612908 and 1206369. Primer 1206368 binds to the mdhB locus 5' of the region targeted, while primer 0613109 binds to the RKI terminator and amplifies in the anti-sense direction. Generation of an approximately 3.3 kbp band by PCR with these primers indicates the occurrence of the desired integration event at the mdhB locus. Primer 0612908 binds in the URA3 coding region, while primer 1206369 binds in the mdhB locus 3' of the region targeted and amplifies in the anti-sense direction. Generation of an approximately 4.6 kbp band by PCR with these primers indicates the occurrence of the desired integration event at the mdhB locus.

Template DNA for the PCRs was prepared by resuspending a small amount of yeast in 10 µL of water. Forty µL of Y-lysis buffer and 2 µL of Zymolyase were then added and the resuspended yeast cells were incubated at 37° C. for 30 minutes. The tubes were then shifted to 4° C. until PCR.

The PCRs (25 µL) were composed of 1 µL of template DNA (as described above) for the strain to be screened, 1× LongAmp® Taq Reaction Buffer, 0.4 µM of the sense primer, 0.4 µM of the anti-sense primer, 300 µM each of dATP, dCTP, dGTP, and dTTP, and 2.5 units of LongAmp® Taq DNA polymerase. The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 5 minutes, with a final extension at 65° C. for 10 minutes. Following thermocycling, the PCR products were separated by 0.9% agarose gel electrophoresis in TBE buffer and the sizes of the bands visualized and interpreted as described above. An isolated transformant having the desired bands was designated *I. orientalis* yMhCt212. The transformant genotype for *I. orientalis* yMhCt212 is shown in Table 16.

TABLE 16

| Strain | Parent strain | Genotype |
|---|---|---|
| yMhCt212 | *I. orientalis* CNB1 | mdhBΔ::(PDC$_{promo}$-AaADC r4, URA3, TDH3$_{promo}$-AaADC)/MDHB |

Example 14: Construction of a Yeast Strain Expressing a Heterologous *Tribolium castaneum* Aspartate 1-Decarboxylase at the mdhB Locus This Example describes the construction of yeast cells containing two copies of polynucleotides encoding the *Tribolium castaneum* ADC of SEQ ID NO: 165 (codon-optimized coding sequences of SEQ ID NOs: 232 and 233) at the mdhB locus with one copy under control of the *I. orientalis* PDC promoter and one copy under the control of the *I. orientalis* TDH3 promoter.

Construction of a Left-Hand Fragment

To create a left-hand plasmid with a single *Tribolium castaneum* ADC coding sequence, a synthetic DNA fragment encoding the 5' region of *Tribolium castaneum* ADC r7 codon optimized for *I. orientalis* (nucleotides 1-840 of SEQ ID NO: 232) with a 5' extension of the sequence shown below was synthesized as a GeneArt® String™ (Life Technologies).

(SEQ ID NO: 234)
5'-CACAGCAAAACACAAAAAGCTAGCTAAA-3'

A second synthetic DNA fragment encoding a PstI site, the 3' region of the *Tribolium castaneum* ADC r7 codon optimized for *I. orientalis* (nucleotides 781-1623 of SEQ ID NO: 232), a 3' extension ending with a second PstI site (sequence of this 3' extension shown below) was synthesized from GeneArt® (Life Technologies).

(SEQ ID NO: 235)
5'-TTAATTAATTTATTTTACTAGTCTGCAG-3'

This 3' *Tribolium castaneum* ADC r7 gene fragment was liberated from the synthetic gene vector via PstI digestion. The resulting fragments were separated by 0.9% agarose gel electrophoresis in TAE buffer where an 871 bp band was excised from the gel and purified using a NUCLEOSPIN® Extract II Kit according to the manufacturer's instructions.

Figure 27:
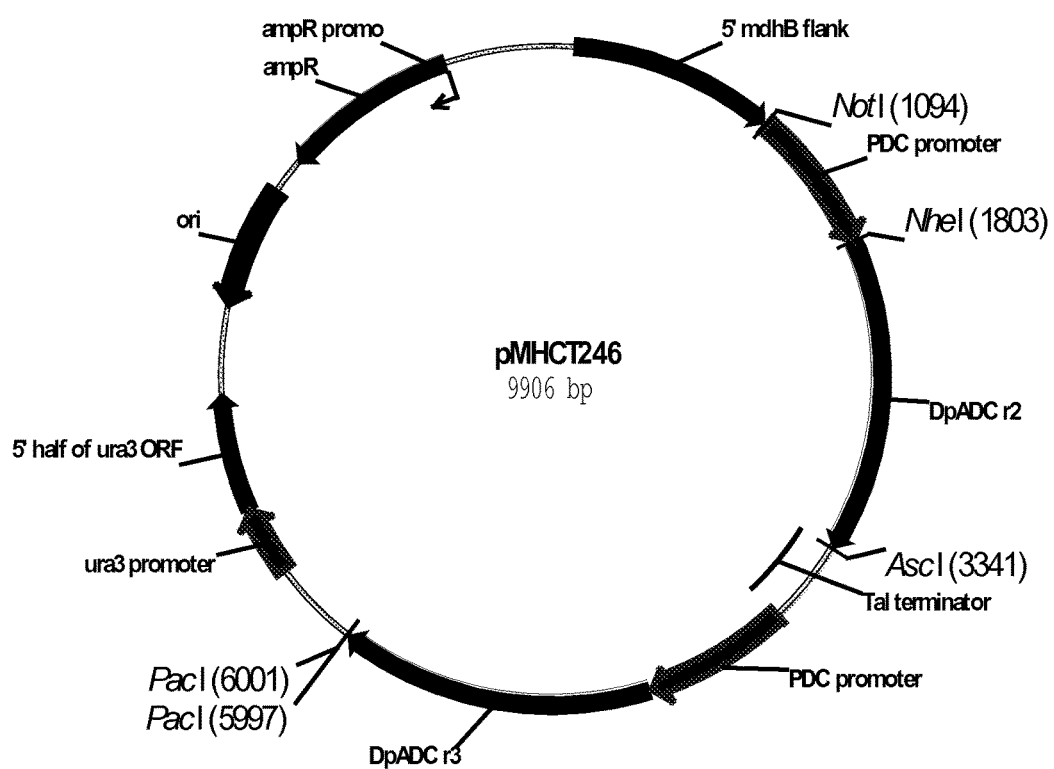
FIG. 27 shows a plasmid map of pMHCT246.
Figure 28:
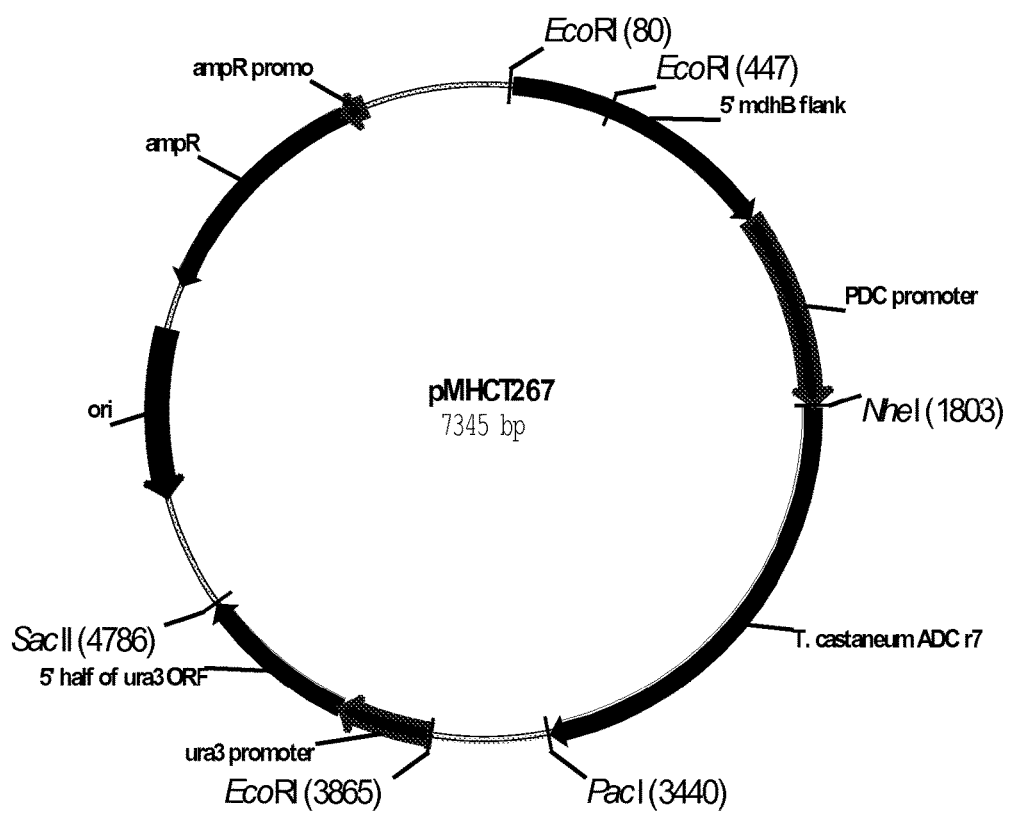
FIG. 28 shows a plasmid map of pMHCT267.
Figure 29:
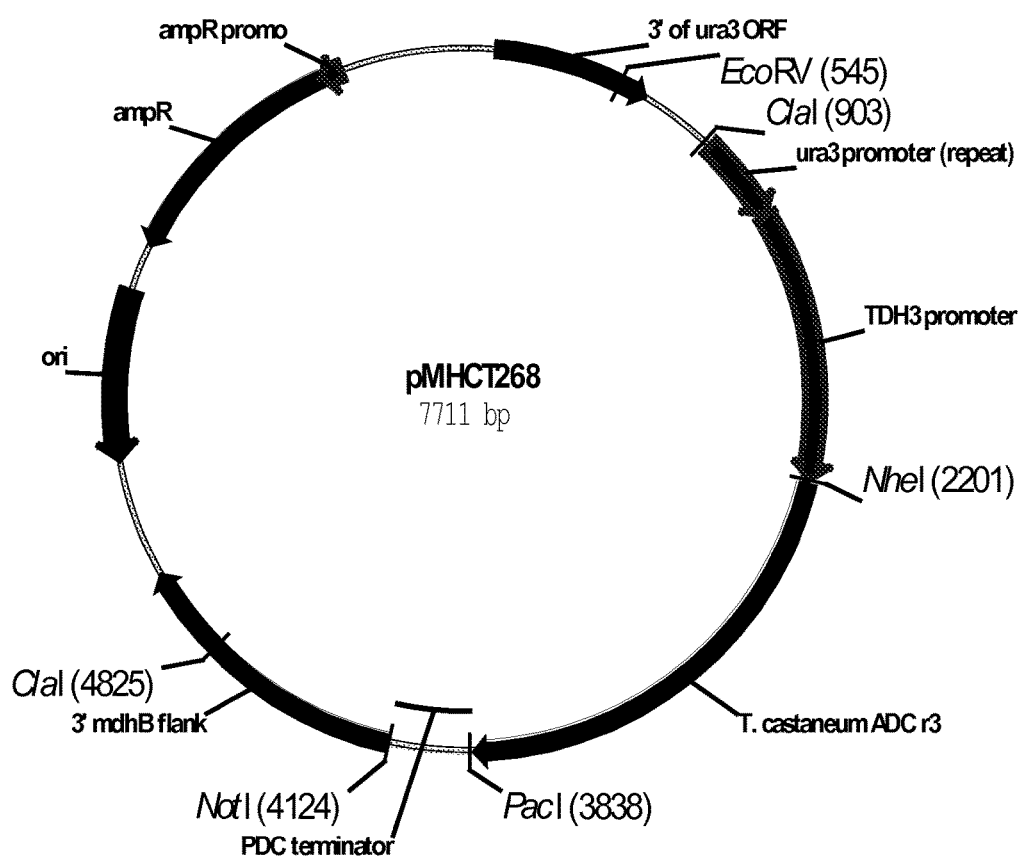
FIG. 29 shows a plasmid map of pMHCT268.

Plasmid pMHCT246 (FIG. 27) is analogous to pMHCT238 (Example 8) except that a DNA fragment with homology to DNA 5' of the malate dehydrogenase B (mdhB) locus (SEQ ID NO: 230) was inserted 5' of the first PDC promoter in pMHCT238 to allow targeting to the mdhB locus. Plasmid pMHCT246 was digested with NheI and PacI and the resulting fragments were separated by 0.9% agarose gel electrophoresis in TAE buffer where an approximately 5.7 kbp band was excised from the gel and purified using a NUCLEOSPIN® Extract II Kit according to the manufacturer's instructions. The purified fragments described above were joined together using an IN-FUSION™ HD Cloning Kit (Clontech Laboratories, Inc.) according to the manufacturer's instructions in a reaction (10 µl) composed of 1×HD Pre-Mix (Clontech Laboratories, Inc.), 3.8 µl of the NheI/PacI pMHCT246 fragment, 0.5 µl of the 5' *Tribolium castaneum* ADC gene fragment String, and 1.1 µl of the 3' *Tribolium castaneum* ADC gene fragment via PstI digestion. Two µl of the reaction were used to transform Stellar™ Competent Cells according to the manufacturer's instructions. The transformation reaction was spread onto 2×YT+ amp plates and incubated at room temperature for approximately 72 hours. Putative transformant colonies were isolated from the selection plates and plasmid DNA was prepared from each one using a BIOROBOT® 9600 and screened for the desired integration of both of the *Tribolium castaneum* ADC gene fragments via NheI and PacI double digestion. One transformant was identified as containing a plasmid with the *Tribolium castaneum* ADC r7coding region and was designated plasmid pMHCT267 (FIG. 28).

Plasmid pMHCT267 is a left-hand *I. orientalis* mdhB targeting construct containing the *I. orientalis* PDC promoter driving expression of the *Tribolium castaneum* ADC r7 coding sequence (SEQ ID NO: 232) codon-optimized for expression in *I. orientalis*, the *I. orientalis* RKI terminator, the *I. orientalis* URA3 promoter, and the 5' fragment of the *I. orientalis* URA3 ORF.

Construction of a Right-Hand Fragment

To create a right-hand plasmid with a single *Tribolium castaneum* ADC coding sequence, a synthetic DNA fragment encoding the 5' region of *Tribolium castaneum* ADC r3 codon optimized for *I. orientalis* (nucleotides 1-840 of SEQ ID NO: 233) with a 5' extension of the sequence shown below was synthesized as a GeneArt® String™ (Life Technologies).

```
                                        (SEQ ID NO: 236)
5'-CACACAAACAAACACAGCTAGCTAAA-3'
```

A second synthetic DNA fragment encoding a PstI site, the 3' region of the *Tribolium castaneum* ADC r3 codon optimized for *I. orientalis* (nucleotides 781-1623 of SEQ ID NO: 233) a 3' extension ending with a second PstI site (sequence of this 3' extension shown below) was ordered from GeneArt® (Life Technologies).

```
                                        (SEQ ID NO: 237)
5'-TTAATTAACATCTGAATGTAAAATGCTGCAG-3'
```

The 3' *Tribolium castaneum* ADC gene fragment was liberated from the synthetic gene vector via PstI digestion. The resulting fragments were separated by 0.9% agarose gel electrophoresis in TAE buffer where an 871 bp band was excised from the gel and purified using a NUCLEOSPIN® Extract II Kit according to the manufacturer's instructions.

Plasmid pCKLE107 (Example 13) was digested with NheI and PacI and the resulting fragments were separated by 0.9% agarose gel electrophoresis in TAE buffer where an approximately 6.1 kbp band was excised from the gel and purified using a NUCLEOSPIN® Extract II Kit according to the manufacturer's instructions.

The purified fragments described above were joined together using an IN-FUSION™ HD Cloning Kit according to the manufacturer's instructions in a reaction (10 μl) composed of 1×HD Pre-Mix, 5 μl of the NheI/PacI pCKLE107 fragment, 0.1 μl of the 5' *Tribolium castaneum* ADC r3 gene fragment String, and 0.2 μl of the 3' *Tribolium castaneum* ADC r3 gene fragment via PstI digestion. Two μl of the reaction were used to transform Stellar™ Competent Cells according to the manufacturer's instructions. The transformation reaction was spread onto 2×YT+amp plates and incubated at room temperature for approximately 72 hours. Several of the resulting transformants were screened for proper integration of the *Tribolium castaneum* ADC r3 gene fragments with a NheI and PacI double digestion. For one transformant, the *Tribolium castaneum* ADC r3 coding region was confirmed by DNA sequencing and this confirmed plasmid was designated pMHCT268 (FIG. 29).

Plasmid pMHCT268 is a right-hand *I. orientalis* mdhB targeting construct containing the 3' fragment of the *I. orientalis* URA3 ORF, the *I. orientalis* URA3 promoter, the *I. orientalis* TDH3 promoter driving expression of an *Tribolium castaneum* ADC r3 coding sequence (SEQ ID NO: 233) codon-optimized for expression in *I. orientalis*, and the *I. orientalis* PDC terminator.

Integration of the Left-Hand and Right-Hand Fragments

The Examples above describe creation of left-hand and right-hand constructs for targeting expression of two nucleotide variants of the *Tribolium castaneum* ADC gene codon-optimized for expression in *I. orientalis* at the mdhB locus. Prior to transformation into *I. orientalis,* 12.6 μg of pMHCT267 were digested with HpaI and SacII to release the desired transforming DNA from the pUC19 backbone vector. Likewise, 12.9 μg of pMHCT268 were digested with EcoRI and SacII to release the desired transforming DNA from the pUC19 backbone vector. For pMHCT267, the approximately 4.7 kbp containing band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. For pMHCT268, the approximately 5.1 kbp band (containing the desired expression cassette) was separated from the vector DNA by 0.9% agarose gel electrophoresis in TAE buffer, excised from the gel, and purified using a NUCLEOSPIN® Extract II Kit according to the manufacturer's instructions. Then approximately 430 ng of the HpaI/SacII pMHCT267 fragment and approximately 175 ng of the EcoRI/SacII pMHCT268 fragment were used to transform *I. orientalis* CNB1 as described in Example 1.

Transformants were selected on SD ura− plates incubated at 37° C. for growth. Six transformants were picked the following day and restreaked for single colonies on SD ura− plates (plates lacking uracil) and grown at 37° C. overnight. Then a single colony was picked from each of the streaks generated by each initial transformant and restreaked on SD ura− plates.

Following the round of single colony purification and outgrowth, PCRs were performed to verify the desired targeted integration occurred as described herein. Correct targeting of the pMHCT267 and pMHCT268 fragments to the mdhB locus was verified using primers 1206368 and 0613109 as well as primers 0612908 and 1206369. Primer 1206368 binds to the mdhB locus 5' of the region targeted, while primer 0613109 binds to the RKI terminator and amplifies in the anti-sense direction. Generation of an approximately 3.2 kbp band by PCR with these primers indicates the occurrence of the desired integration event at the mdhB locus. Primer 0612908 binds in the URA3 coding region, while primer 1206369 binds in the mdhB locus 3' of the region targeted and amplifies in the anti-sense direction. Generation of an approximately 4.5 kbp band by PCR with these primers indicates the occurrence of the desired integration event at the mdhB locus.

Template DNA for the PCRs was prepared by resuspending a small amount of yeast in 10 μL of water. Forty μL of Y-lysis buffer and 2 μL of Zymolyase were then added and the resuspended yeast cells were incubated at 37° C. for 30 minutes. The tubes were then shifted to 4° C. until PCR.

The PCRs (25 μL) were composed of 1 μL of template DNA (as described above) for the strain to be screened, 1× LongAmp® Taq Reaction Buffer, 0.4 μM of the sense primer, 0.4 μM of the anti-sense primer, 300 μM each of dATP, dCTP, dGTP, and dTTP, and 2.5 units of LongAmp® Taq DNA polymerase. The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 5 minutes, with a final extension at 65° C. for 10 minutes. Following thermocycling, the PCR products were separated by 0.9% agarose gel electrophoresis in TBE buffer and the sizes of the bands visualized and interpreted as described above. Two independently isolated transformants having the desired bands were designated *I. orientalis* yMhCt244 and yMhCt245. The transformant genotypes for *I. orientalis* yMhCt244 and yMhCt245 are shown in Table 17.

TABLE 17

| Strain | Parent strain | Genotype |
| --- | --- | --- |
| yMhCt244 | I. orientalis | mdhBΔ::(PDC$_{promo}$-TcADC r7, URA3, |
| yMhCt245 | CNB1 | TDH3$_{promo}$-TcADC r3)/MDHB |

Example 15: 3-HP Production in Recombinant Yeast Strains Expressing a Heterologous Insect Aspartate 1-Decarboxylase at the mdhB Locus This Example describes 3-HP production characteristics in yeast strains expressing two copies of polynucleotides encoding *A. aegypti* ADC at the mdhB locus (*I. orientalis* yMhCt212, Example 13) compared to yeast strains expressing two copies of polynucleotides encoding *T. castaneum* ADC at the mdhB locus (*I. orientalis* yMhCt244 and yMhCt245, Example 14).

*I. orientalis* yMhCt212, yMhCt244, and yMhCt245 were grown in shake flasks according to the following procedure. The strains were streaked out for single colonies on SD ura– plates and incubated at 30° C. for 1-2 days. Seed cultures were prepared in 125 ml baffled flasks containing 25 mL of CNB1 medium inoculated with 1-2 colonies from the SD ura– plate. The seed cultures were grown for approximately 18 hours at 30° C. with shaking at 200 rpm. Small aliquots of the cultures were then withdrawn to measure the OD$_{600}$ until reaching an OD$_{600}$ of 4-8. The seed flask cultures were diluted to an OD$_{600}$=0.16 and used to inoculate 125 ml baffled flasks containing 50 mL of CNB1 medium. The shake flasks were incubated at 30° C. for 18 hours with shaking at 140 rpm. Samples of the cultures were then withdrawn to measure the OD$_{600}$ of the cultures and 3-HP production. For 3-HP production, the samples were centrifuged and the supernatants were used for 3-HP analysis according to Example 5.

The results in Table 18 show the 3-HP g/L produced by the strain divided by the optical density (OD$_{600}$) of the strain. Each strain was grown in duplicate and the (3-HP g/L)/OD shown is the average for each set of duplicates. The data showed that the *A. aegypti* ADC resulted in markedly more 3-HP production than the *T. castaneum* ADC.

TABLE 18

| Strain | Expressed ADC | (3-HP g/L)/OD |
| --- | --- | --- |
| yMhCt212 | SEQ ID NO: 162 | 0.369 |
| yMhCt244 | SEQ ID NO: 165 | 0.129 |
| yMhCt245 | SEQ ID NO: 165 | 0.136 |

Although the foregoing has been described in some detail by way of illustration and example for the purposes of clarity of understanding, it is apparent to those skilled in the art that any equivalent aspect or modification may be practiced. Therefore, the description and examples should not be construed as limiting the scope of the invention.

The present invention is further described by the following numbered paragraphs:

[1] A recombinant yeast cell comprising a heterologous polynucleotide encoding an aspartate 1-decarboxylase of the Class Insecta, Bivalvia, Branchiopoda, Gastropoda, or Leptocardii, wherein the cell is capable of producing 3-hydroxypropionic acid (3-HP).

[2] The recombinant yeast cell of paragraph 1, wherein the aspartate 1-decarboxylase is an aspartate 1-decarboxylase of the Class Insecta.

[3] The recombinant yeast cell of paragraph 1 or 2, wherein the aspartate 1-decarboxylase of the Class Insecta is an insect aspartate 1-decarboxylase of an Order selected from the group consisting of Blattodea, Coleoptera, Dermaptera, Diptera, Embiidina, Ephemeroptera, Hemiptera, Hymenoptera, Lepidoptera, Mantoptera, Mecoptera, Megaloptera, Microcoryphia, Neuroptera, Notoptera, Odonata, Orthoptera, Phasmatodea, Plecoptera, Psocoptera, Raphidioptera, Siphonaptera, Strepsiptera, Thysanoptera, Trichoptera, Zoraptera, and Zygentoma.

[4] The recombinant yeast cell of any of paragraphs 1-3, wherein the aspartate 1-decarboxylase has at least 60%, e.g., at least 65%, at least 75%, at least 80%, at least 85%, at least 90%, at least 95%, at least 96%, at least 97%, at least 98%, at least 99%, or 100% sequence identity to the amino acid sequence of SEQ ID NO: 162, 163, 164, 165, 166, 167, 168, 169, 170, 171, 172, 173, 174, 175, 176, 177, 178, 179, 180, 181, 182, 183, 184, 185, 186, 187, 188, 189, 190, or 191.

[5] The recombinant yeast cell of any of paragraphs 1-4, wherein the aspartate 1-decarboxylase has an amino acid sequence comprising or consisting of SEQ ID NO: 162, 163, 164, 165, 166, 167, 168, 169, 170, 171, 172, 173, 174, 175, 176, 177, 178, 179, 180, 181, 182, 183, 184, 185, 186, 187, 188, 189, 190, or 191.

[6] The recombinant yeast cell of paragraph 1, wherein the aspartate 1-decarboxylase is an aspartate 1-decarboxylase of the Class Branchiopoda.

[7] The recombinant yeast cell of paragraph 6, wherein the aspartate 1-decarboxylase has at least 60%, e.g., at least 65%, at least 75%, at least 80%, at least 85%, at least 90%, at least 95%, at least 96%, at least 97%, at least 98%, at least 99%, or 100% sequence identity to the amino acid sequence of SEQ ID NO: 192.

[8] The recombinant yeast cell of paragraph 6 or 7, wherein the aspartate 1-decarboxylase has an amino acid sequence comprising or consisting of SEQ ID NO: 192.

[9] The recombinant yeast cell of paragraph 1, wherein the aspartate 1-decarboxylase is an aspartate 1-decarboxylase of the Class Gastropoda.

[10] The recombinant yeast cell of paragraph 9, wherein the aspartate 1-decarboxylase has at least 60%, e.g., at least 65%, at least 75%, at least 80%, at least 85%, at least 90%, at least 95%, at least 96%, at least 97%, at least 98%, at least 99%, or 100% sequence identity to the amino acid sequence of SEQ ID NO: 193.

[11] The recombinant yeast cell of paragraph 9 or 10, wherein the aspartate 1-decarboxylase has an amino acid sequence comprising or consisting of SEQ ID NO: 193.

[12] The recombinant yeast cell of paragraph 1, wherein the aspartate 1-decarboxylase is an aspartate 1-decarboxylase of the Class Leptocardii.

[13] The recombinant yeast cell of paragraph 12, wherein the aspartate 1-decarboxylase has at least 60%, e.g., at least 65%, at least 75%, at least 80%, at least 85%, at least 90%, at least 95%, at least 96%, at least 97%, at least 98%, at least 99%, or 100% sequence identity to the amino acid sequence of SEQ ID NO: 194.

[14] The recombinant yeast cell of paragraph 12 or 13, wherein the aspartate 1-decarboxylase has an amino acid sequence comprising or consisting of SEQ ID NO: 194.

[15] The recombinant yeast cell of paragraph 1, wherein the aspartate 1-decarboxylase is an aspartate 1-decarboxylase of the Class Bivalvia.

[16] The recombinant yeast cell of paragraph 15, wherein the aspartate 1-decarboxylase has at least 60%, e.g., at least 65%, at least 75%, at least 80%, at least 85%, at least 90%, at least 95%, at least 96%, at least 97%, at least 98%, at least 99%, or 100% sequence identity to the amino acid sequence of SEQ ID NO: 195.

[17] The recombinant yeast cell of paragraph 15 or 16, wherein the aspartate 1-decarboxylase has an amino acid sequence comprising or consisting of SEQ ID NO: 195.

[18] The recombinant yeast cell of any of paragraphs 1-17, wherein the aspartate 1-decarboxylase comprises a glutamine at a residue corresponding to position 377 of the amino acid sequence of SEQ ID NO: 162.

[19] The recombinant yeast cell of paragraph 18, wherein the aspartate 1-decarboxylase comprises a glutamine at a position corresponding to position 377 of the amino acid sequence of SEQ ID NO: 162, and a partial amino acid sequence having at least 75%, e.g., at least 80%, at least 85%, 90%, 95%, 97%, 98%, 99%, or 100% sequence identity to amino acids 382-516 SEQ ID NO: 162.

[20] The recombinant yeast cell of any of paragraphs 1-19, wherein the aspartate 1-decarboxylase comprises a $F_1aa_{19}S_2aaY_3$ motif or an $Y_1aa_{19}S_2aaY_3$ motif, wherein $F_1$ is phenylalanine, $Y_1$ is tyrosine, $aa_{19}$ is an intervening sequence of nineteen amino acids, $S_2$ is serine, aa is a single amino acid, and $Y_3$ is tyrosine.

[21] The recombinant yeast cell of any of paragraphs 1-20, wherein the heterologous polynucleotide encoding the aspartate 1-decarboxylase comprises a promoter foreign to the polynucleotide encoding the aspartate 1-decarboxylase.

[22] The recombinant yeast cell of any of paragraphs 1-21, wherein the cell produces a greater amount of 3-HP compared to the cell without the heterologous polynucleotide encoding the aspartate 1-decarboxylase, when cultivated under identical conditions (e.g., at least 10%, at least 15%, at least 20%, at least 25%, at least 30%, at least 35%, at least 40%, at least 45%, at least 50%, at least 75%, at least 100%, at least 150%, at least 200%, at least 250%, at least 300%, or at least 500% more).

[23] The recombinant yeast cell of any one of paragraphs 1-22, wherein the cell produces a greater amount of 3-HP (e.g., at least 10%, at least 15%, at least 20%, at least 25%, at least 30%, at least 35%, at least 40%, at least 45%, at least 50%, at least 75%, at least 100%, at least 200%, at least 300%, or at 500% more) compared to a second recombinant yeast cell, when cultivated under the same conditions; wherein the second yeast cell is identical to the yeast cell encoding the insect aspartate 1-decarboxylase with the proviso that the second yeast cell encodes the *Bacillus licheniformis* aspartate 1-decarboxylase of SEQ ID NO: 139 in place of the insect aspartate 1-decarboxylase.

[24] The recombinant yeast cell of any of paragraphs 1-23, wherein the cell further comprises one or more heterologous polynucleotides selected from: a heterologous polynucleotide encoding a PYC; a heterologous polynucleotide encoding an AAT; a heterologous polynucleotide encoding a BAAT or gabT; a heterologous polynucleotide encoding a 3-HPDH; and a heterologous polynucleotide encoding a PPC.

[25] The recombinant yeast cell of paragraph 24, wherein the cell further comprises a heterologous polynucleotide encoding a PYC.

[26] The recombinant yeast cell of paragraph 24, wherein the PYC has at least 50%, e.g., at least 60%, at least 65%, at least 70%, at least 75%, at least 80%, at least 85%, at least 90%, at least 95%, at least 96%, at least 97%, at least 98%, at least 99%, or 100% sequence identity to the amino acid sequence of SEQ ID NO: 2, 3, 4, 5, 6, 7, or 8.

[27] The recombinant yeast cell of paragraph 24, wherein the PYC has an amino acid sequence comprising or consisting of SEQ ID NO: 2, 3, 4, 5, 6, 7, or 8.

[28] The recombinant yeast cell of any of paragraphs 24-27, wherein the cell further comprises a heterologous polynucleotide encoding an AAT.

[29] The recombinant yeast cell of paragraph 28, wherein the AAT has at least 50%, e.g., at least 60%, at least 65%, at least 70%, at least 75%, at least 80%, at least 85%, at least 90%, at least 95%, at least 96%, at least 97%, at least 98%, at least 99%, or 100% sequence identity to the amino acid sequence of SEQ ID NO: 14, 15, or 16.

[30] The recombinant yeast cell of paragraph 28, wherein the AAT has an amino acid sequence comprising or consisting of SEQ ID NO: 14, 15, or 16.

[31] The recombinant yeast cell of any of paragraphs 24-30, wherein the cell further comprises a heterologous polynucleotide encoding a BAAT or gabT.

[32] The recombinant yeast cell of paragraph 31, wherein the BAAT or gabT has at least 60%, e.g., at least 65%, at least 70%, at least 75%, at least 80%, at least 85%, at least 90%, at least 95%, at least 96%, at least 97%, at least 98%, at least 99%, or 100% sequence identity to the amino acid sequence of SEQ ID NO: 20, 21, 22, 23, or 24.

[33] The recombinant yeast cell of paragraph 31, wherein the BAAT or gabT has an amino acid sequence comprising or consisting of SEQ ID NO: 20, 21, 22, 23, or 24.

[34] The recombinant yeast cell of any of paragraphs 31-33, wherein said BAAT or gabT is a BAAT that is also a gabT.

[35] The recombinant yeast cell of any of paragraphs 24-34, wherein the cell further comprises a heterologous polynucleotide encoding a 3-HPDH (e.g. a 3-HPDH that has increased specificity for NAD(H) compared to NADP(H)).

[36] The recombinant yeast cell of paragraph 35, wherein the 3-HPDH has at least 60%, e.g., at least 65%, at least 70%, at least 75%, at least 80%, at least 85%, at least 90%, at least 95%, at least 96%, at least 97%, at least 98%, at least 99%, or 100% sequence identity to the amino acid sequence of SEQ ID NO: 26, 27, 28, 29, 30, 31, 32, 33, 34, or 129.

[37] The recombinant yeast cell of paragraph 35, wherein the 3-HPDH has an amino acid sequence comprising or consisting of SEQ ID NO: 26, 27, 28, 29, 30, 31, 32, 33, 34, or 129.

[38] The recombinant yeast cell of any of paragraphs 35-37, wherein the 3-HPDH is also a HIBADH.

[39] The recombinant yeast cell of any of paragraphs 35-37, wherein the 3-HPDH is also a 4-hydroxybutyrate dehydrogenase.

[40] The recombinant yeast cell of any of paragraphs 24-39, wherein the cell further comprises a heterologous polynucleotide encoding a PPC.

[41] The recombinant yeast cell of paragraph 40, wherein the PPC has at least 60%, e.g., at least 65%, at least 70%, at least 75%, at least 80%, at least 85%, at least 90%, at least 95%, at least 96%, at least 97%, at least 98%, at least 99%, or 100% sequence identity to the amino acid sequence of SEQ ID NO: 10, 11, or 12.

[42] The recombinant yeast cell of paragraph 40, wherein the PPC has an amino acid sequence comprising or consisting of SEQ ID NO: 10, 11, or 12.

[43] The recombinant yeast cell of any of paragraphs 1-42, wherein the cell is Crabtree-negative.

[44] The recombinant yeast cell of any of paragraphs 1-42, wherein the cell belongs to a genus selected from

*Candida, Issatchenkia, Kluyveromyces, Pichia, Saccharomyces, Schizosaccharomyces, Torulaspora*, and *Zygosaccharomyces*.

[45] The recombinant yeast cell of paragraph 44, wherein the cell belongs to a clade selected from the *I. orientalis/P. fermentans* clade and the *Saccharomyces* clade.

[46] The recombinant yeast cell of paragraph 44, wherein the cell is selected from *I. orientalis, C. lambica*, and *S. bulderi*.

[47] The recombinant yeast cell of paragraph 43, wherein the cell is an *I. orientalis* yeast cell, e.g., an *I. orientalis* CNB1 yeast cell.

[48] The recombinant yeast cell of any of paragraphs 1-47, wherein the cell further comprises a disruption to one or more endogenous genes encoding a PDC, ADH, GALE, CYB2A, CYB2B, GPD, GPP, ALD, or PCK.

[49] The recombinant yeast cell of paragraph 48, wherein the cell further comprises a disruption to an endogenous gene encoding a PDC.

[50] The recombinant yeast cell of paragraph 49, wherein the cell comprises a disruption to an endogenous gene encoding a PDC having at least 75%, e.g., at least 80%, at least 85%, at least 90%, at least 95%, at least 96%, at least 97%, at least 98%, at least 99%, or 100% sequence identity to SEQ ID NO: 154.

[51] The recombinant yeast cell of paragraph 49, wherein the cell comprises a disruption to an endogenous gene encoding a PDC having an amino acid sequence comprising or consisting of SEQ ID NO: 154.

[52] The recombinant yeast cell of any of paragraphs 49-51, wherein the coding sequence of the gene encoding the PDC has at least 75%, e.g., at least 80%, at least 85%, at least 90%, at least 95%, at least 96%, at least 97%, at least 98%, at least 99%, or 100% sequence identity to SEQ ID NO: 153.

[53] The recombinant yeast cell of any of paragraphs 49-51, wherein the coding sequence of the endogenous gene encoding the PDC comprises or consists of SEQ ID NO: 153.

[54] The recombinant yeast cell of any of paragraphs 49-53, wherein the disruption to the endogenous gene encoding the PDC occurs in the coding sequence of the gene encoding the PDC.

[55] The recombinant yeast cell of any of paragraphs 49-53, wherein the disruption to the endogenous gene encoding the PDC occurs in a promoter sequence of the gene encoding the PDC.

[56] The recombinant yeast cell of any of paragraphs 49-55, wherein the cell produces at least 25% less (e.g., at least 50% less, at least 60% less, at least 70% less, at least 80% less, or at least 90% less) of the PDC and/or PDC activity compared to the cell without the disruption when cultivated under identical conditions.

[57] The recombinant yeast cell of any of paragraphs 49-56, wherein the endogenous gene encoding the PDC is inactivated.

[58] The recombinant yeast cell of any of paragraphs 49-57, wherein the cell produces a decreased amount of ethanol (e.g., at least 25% less, at least 50% less, at least 60% less, at least 70% less, at least 80% less, or at least 90% less) compared to the cell without the disruption to the endogenous gene encoding the PDC when cultivated under identical conditions.

[59] The recombinant yeast cell of any of paragraphs 49-58, wherein the cell produces a greater amount of 3-HP compared to the cell without the disruption to the endogenous gene encoding the PDC when cultivated under identical conditions.

[60] The recombinant yeast cell of any of paragraphs 49-59, wherein the cell is capable of producing at least 10% more (e.g., at least 15%, at least 20%, at least 25%, at least 30%, at least 35%, at least 40%, at least 45%, at least 50%, at least 75%, at least 100%, at least 200%, at least 300%, or at 500% more) 3-HP compared to the cell without the disruption to the endogenous gene encoding the PDC, when cultivated under identical conditions.

[61] The recombinant yeast cell of any of paragraphs 48-60, wherein the cell further comprises a disruption to an endogenous gene encoding a GPD.

[62] The recombinant yeast cell of paragraph 61, wherein the cell comprises a disruption to an endogenous gene encoding a GPD having at least 75%, e.g., at least 80%, at least 85%, at least 90%, at least 95%, at least 96%, at least 97%, at least 98%, at least 99%, or 100% sequence identity to SEQ ID NO: 156.

[63] The recombinant yeast cell of paragraph 61, wherein the cell comprises a disruption to an endogenous gene encoding a GPD having an amino acid sequence comprising or consisting of SEQ ID NO: 156.

[64] The recombinant yeast cell of any of paragraphs 61-63, wherein the coding sequence of the gene encoding the GPD has at least 75%, e.g., at least 80%, at least 85%, at least 90%, at least 95%, at least 96%, at least 97%, at least 98%, at least 99%, or 100% sequence identity to SEQ ID NO: 155.

[65] The recombinant yeast cell of any of paragraphs 61-63, wherein the coding sequence of the endogenous gene encoding the GPD comprises or consists of SEQ ID NO: 155.

[66] The recombinant yeast cell of any of paragraphs 61-65, wherein the disruption to the endogenous gene encoding the GPD occurs in the coding sequence of the gene encoding the GPD.

[67] The recombinant yeast cell of any of paragraphs 61-65, wherein the disruption to the endogenous gene encoding the GPD occurs in a promoter sequence of the gene encoding the GPD.

[68] The recombinant yeast cell of any of paragraphs 61-67, wherein the cell produces at least 25% less (e.g., at least 50% less, at least 60% less, at least 70% less, at least 80% less, or at least 90% less) of the GPD compared to the cell without the disruption when cultivated under identical conditions.

[69] The recombinant yeast cell of any of paragraphs 61-68, wherein the endogenous gene encoding the GPD is inactivated.

[70] The recombinant yeast cell of any of paragraphs 61-69, wherein the cell produces a decreased amount of glycerol (e.g., at least 25% less, at least 50% less, at least 60% less, at least 70% less, at least 80% less, or at least 90% less) compared to the cell without the disruption to the endogenous gene encoding the GPD when cultivated under identical conditions.

[71] The recombinant yeast cell of any of paragraphs 61-70, wherein the cell produces a greater amount of 3-HP compared to the cell without the disruption to the endogenous gene encoding the GPD when cultivated under identical conditions.

[72] The recombinant yeast cell of paragraph 61-71, wherein the cell is capable of producing at least 10% more (e.g., at least 15%, at least 20%, at least 25%, at least 30%, at least 35%, at least 40%, at least 45%, at least 50%, at least 75%, at least 100%, or at least 200%, at least 300%, or at 500% more) 3-HP compared to the cell without the disruption to the endogenous gene encoding the GPD, when cultivated under identical conditions.

[73] The recombinant yeast cell of any of paragraphs 1-72, wherein the cell is capable of growing at a pH of less than 4 in media containing 75 g/L or greater 3-HP.

[74] The recombinant yeast cell of any of paragraphs 1-73, wherein the cell is a 3-HP-resistant yeast cell.

[75] The recombinant yeast cell of any of paragraphs 1-74, wherein the cell has undergone mutation and/or selection, such that the mutated and/or selected cell possesses a higher degree of resistance to 3-HP than a wild-type cell of the same species.

[76] The recombinant yeast cell of paragraph 75, wherein the cell has undergone mutation and/or selection before being genetically modified with the heterologous polynucleotide encoding an insect aspartate 1-decarboxylase.

[77] The recombinant yeast cell of paragraph 75 or 76, wherein the cell has undergone selection in the presence of lactic acid or 3-HP.

[78] The recombinant yeast cell of paragraph 77, wherein the selection is chemostat selection.

[79] The recombinant yeast cell of any one of paragraphs 1-78, wherein the yeast cell is unable to ferment pentose sugars.

[80] A composition comprising the recombinant host cell of any of paragraphs 1-79.

[81] The composition of paragraph 80, wherein the composition comprises a fermentable medium.

[82] The composition of paragraph 81, wherein the fermentable medium comprises sucrose, glucose, and/or fructose.

[83] The composition of any of paragraphs 80-82, further comprising 3-HP.

[84] The composition of paragraph 83, wherein the 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[85] The composition of any of paragraphs 81-84, wherein the medium is at a pH of less than 5, e.g., in the range of about 1.5 to about 4.5, about 2.0 to about 4.0, or about 2.0 to about 3.5.

[86] The composition of any of paragraphs 81-85, wherein the fermentable medium comprises less than 1% pentose sugars.

[87] A method of producing 3-HP, comprising: (a) cultivating the recombinant yeast cell of any of paragraphs 1-79 in a fermentable medium under suitable conditions to produce 3-HP; and (b) recovering the 3-HP.

[88] The method of paragraph 87, wherein the fermentable medium comprises sucrose, glucose, and/or fructose.

[89] The method of paragraph 87 or 88, wherein the produced 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[90] The method of any of paragraphs 87-89, wherein the resulting 3-HP is substantially pure.

[91] The method of any one of paragraphs 87-90, wherein the fermentable medium comprises sucrose, glucose, and/or fructose.

[92] The method of any one of paragraphs 87-91, wherein the yeast cell is an *I. orientalis* yeast cell and the fermentable medium comprises less than 1% pentose sugars.

[93] The method of any of paragraphs 87-92, wherein the fermentable medium is at a pH of less than 5, e.g., in the range of about 1.5 to about 4.5, about 2.0 to about 4.0, or about 2.0 to about 3.5.

[94] A method of producing acrylic acid or a salt thereof, comprising: (a) cultivating the recombinant yeast cell of any of paragraphs 1-79 in a fermentable medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

[95] The method of any paragraph 94, wherein the recombinant yeast cell is an *I. orientalis* yeast cell cultivated in a fermentable medium comprising less than 1% pentose sugars.

SEQUENCE LISTING (237 sequences)

SEQ ID NO: 1 - DNA, 3543 bp, Issatchenkia orientalis
atgtcaactgtggaagatcactcctccctacataaattgagaaaggaatctgagattctttccaatgcaaacaaaatcttagtggctaatagaggtgaaattccaattagaattttcaggtcagcccatgaattgtcaatgcatactgtggcgatctattcccatgaagatcggttgtccatgcataggttgaaggccgacgaggcttatgcaatcggtaagactggtcaatattcgccagttcaagcttatctacaaattgacgaaattatcaaaatagcaaaggaacatgatgtttccatgatccatccaggttatggtttcttatctgaaaactccgaattcgcaaagaaggttgaagaatccggtatgatttgggttgggcctcctgctgaagttattgattctgttggtgacaaggtttctgcaagaaatttggcaattaaatgtgacgttcctgttgttcctggtaccgatggtccaattgaagacattgaacaggctaaacagtttgtggaacaatatggttatcctgtcattataaaggctgcatttggtggtggtggtagaggtatgagagttgttagagaaggtgatgatatagttgatgctttccaaagagcgtcatctgaagcaaagtctgcctttggtaatggtacttgttttattgaaagatttttggataagccaaaacatattgaggttcaattattggctgataattatggtaacacaatccatctctttgaaagagattgttctgttcaaagaagacatcaaaaggttgttgaaattgcacctgccaaaactttacctgttgaagttagaaatgctatattaaaggatgctgtaacgttagctaaaaccgctaactatagaaatgctggtactgcagaatttttagttgattcccaaaacagacattattttattgaaattaatccaagaattcaagttgaacatacaattactgaagaaatcacgggtgttgatattgttgccgctcaaattcaaattgctgcaggtgcatcattggaacaattgggtctattacaaaacaaaattacaactagaggttttgcaattcaatgtagaattacaaccgaggatcctgctaagaattttgccccagatacaggtaaaattgaggtttatagatctgcaggtggtaacggtgtcagattagatggtggtaatgggtttgccggtgctgttatatctcctcattatgactcgatgttggttaaatgttcaacatctggttctaactatgaaattgccagaagaaagatgattagagctttagttgaatttagaatcagaggtgtcaagaccaatattcctttcttattggcattgctaactcatccagttttcatttcgggtgattgttggacaacttttattgatgataccccttcgttattcgaaatggtttcttcaaagaatagagcccaaaaattattggcatatattggtgacttgtgtgtcaatggttcttcaattaaaggtcaaattggtttccctaaattgaacaaggaagcagaaatcccagatttgttggatccaaatgatgaggttattgatgtttctaaaccttctaccaatggtctaagaccgtatctattaaagtatggaccagatgcgttttccaaaaaagttcgtgaattcgatggttgtatgattatggataccacctggagagatgcacatcaatcattattggctacaagagttagaactattgatttactgagaattgctccaacgactagtcatgccttacaaaatgcatttgcattagaatgttggggtggcgcaacatttgatgttgcgatgaggttcctctatgaagatccttgggagagattaagacaacttagaaaggcagttccaaatattcctttccaaatgttattgagaggtgctaatggtgttgcttattcgtcattacctgataatgcaattgatcattttgttaagcaagcaaaggataatggtgttgatattttcagagtctttgatgctttgaacgatttggaacaattgaaggttggtgttgatgctgtcaagaaagccggaggtgttgttgaagctacagtttgttactcaggtgatatgttaattccaggtaaaaagtataacttggattattatttagagactgttggaaagattgtggaaatgggtacccatattttaggtattaaggatatggctggcacgttaaagccaaaggctgctaagttgttgattggctcgatcagatcaaaataccctgacttggttatccatgtccatacccatgactctgctggtaccggtatttcaacttatgttgcatgcgcattggcaggtgccgacattgtcgattgtgcaatcaattcgatgtctggtttaacctctcaaccttcaatgagtgcttttattgctgctttagatggtgatatcgaaactggtgttccagaacattttgcaagacaattagatgcatactgggcagaaatgagattgttatactcatgtttcgaagccgacttgaagggaccagacccagaagtttataaacatgaaattccaggtggacagttgactaacctaatcttccaagcccaacaagttggtttgggtgaacaatgggaagaaactaagaagaagtatgaagatgctaacatgttgttgggtgatattgtcaaggttaccccaacctccaaggttgttggtgatttagcccaatttatggtttctaataaattagaaaaagaagatgttgaaaaacttgctaatgaattagatttcccagattcagttcttgatttctttgaaggattaatgggtacaccatatggtggattcccagagcctttgagaacaaatgtcatttccggcaagagaagaaaattaaagggtagaccaggtttagaattagaacctttcaacctcgaggaaatcagagaaaatttggtttccagatttggtccaggtattactgaatgtgatgttgcatcttataacatgtatccaaaggtttacgagcaatatcgtaaggtggttgaaaaatatggtgatttatctgttttaccaacaaaagcatttttggctcctccaactattggtgaagaagttcatgtggaaattgagcaaggtaagactttgattattaagttattagccatttctgacttgtctaaatctcatggtacaagagaagtatactttgaattgaatggtgaaatgagaaaggttacaattgaagataaaacagctgcaattgagactgttacaagagcaaaggctgacggacacaatccaaatgaagttggtgcgccaatggctggtgtcgttgttgaagttagagtgaagcatggaacagaagttaagaagggtgatccattagccgttttgagtgcaatgaaaatggaaatggttatttctgctcctgttagtggtagggtcggtgaagtttttgtcaacgaaggcgattccgttgatatgggtgatttgcttgtgaaaattgccaaagatgaagcgccagcagcttaa

SEQ ID NO: 2 - protein, 1180 aa, Issatchenkia orientalis
MSTVEDHSSLHKLRKESEILSNANKILVANRGEIPIRIFRSAHELSMHTVAIYSHEDRLSMHRLKADEAYAIGKTGQYSPVQAYLQIDEIIKIAKEHDVSMIHPGYGFLSENSEFAKKVEESGMIWVGPPAEVIDSVGDKVSARNLAIKCDVPVVPGTDGPIEDIEQAKQFVEQYGYPVIIKAAFGGGGRGMRVVREGDDIVDAFQRASSEAKSAFGNGTCFIERFLDKPKHIEVQLLADNYGNTIHLFERDCSVQRRHQKVVEIAPAKTLPVEVRNAILKDAVTLAKTANYRNAGTAEFLVDSQNRHYFIEINPRIQVEHTITEEITGVDIVAAQIQIAAGASLEQLGLLQNKITTRGFAIQCRITTEDPAKNFAPDTGKIEVYRSAGGNGVRLDGGNGFAGAVISPHYDSMLVKCSTSGSNYEIARRKMIRALVEFRIRGVKTNIPFLLALLTHPVFISGDCWTTFIDDTPSLFEMVSSKNRAQKLLAYIGDLCVNGSSIKGQIGFPKLNKEAEIPDLLDPNDEVIDVSKPSTNGLRPYLLKYGPDAFSKKVREFDGCMIMDTTWRDAHQSLLATRVRTIDLLRIAPTTSHALQNAFALECWGGATFDVAMRFLYEDPWERLRQLRKAVPNIPFQMLLRGANGVAYSSLPDNAIDHFVKQAKDNGVDIFRVFDALNDLEQLKVGVDAVKKAGGVVEATVCYSGDMLIPGKKYNLDYYLETVGKIVEMGTHILGIKDMAGTLKPKAAKLLIGSIRSKYPDLVIHVHTHDSAGTGISTYVACALAGADIVDCAINSMSGLTSQPSMSAFIAALDGDIETGVPEHFARQLDAYWAEMRLLYSCFEADLKGPDPEVYKHEIPGGQLTNLIFQAQQVGLGEQWEETKKKYEDANMLLGDIVKVTPTSKVVGDLAQFMVSNKLEKEDVEKLANELDFPDSVLDFFEGLMGTPYGGFPEPLRTNVISGKRRKLKGRPGLELEPFNLEEIRENLVSRFGPGITECDVASYNMYPKVYEQYRKVVEKYGDLSVLPTKAFLAPPTIGEEVHVEIEQGKTLIIKLLAISDLSKSHGTREVYFELNGEMRKVTIEDKTAAIETVTRAKADGHNPNEVGAPMAGVVVEVRVKHGTEVKKGDPLAVLSAMKMEMVISAPVSGRVGEVFVNEGDSVDMGDLLVKIAKDEAPAA

SEQ ID NO: 3 - protein, 1154 aa, Rhodobacter sphaeroides
MAEFRKILIANRGEIAIRVMRAANEMGKKTVAVYAEEDKLSLHRFKADEAYRIGEGLSPVGAYLSIPEIIRVAQMSGADAIHPGYGLLSENPDFVEACDAAGIAFIGPKAETMRALGDKASARRVAMAAGVPVIPATEVLGDDMEEIKRQAAEIGYPLMLKASWGGGGRGMRPITSEAELADKVREGRREAEAAFGNGEGYLEKMIQRARHVEVQILGDKYGAIYHLYERDCTVQRRNQKVVERAPAPYLTEEQRTEICELGRRICAHVNYECAGTVEFLMDMDSEKFYFIEVNPRVQVEHTVTEEVTGIDIVQSQIRIAEGATLAEATGCPSQDDIKLSGHALQCRVTTEDPQNNFIPDYGRLTAYRSATGMGIRLDGGTAYAGGVITRYYDSLLVKVTAWAPTPEKAIARMDRALREFRIRGVATNIAFVENLLKHPSFLDYSYTTKFIDTTPDLFNFKPRRDRATKILTYIADITVNGHPETAGRVRPSAELKDPKAPEPKGAPQPGTRTLLEEKGPQAVADWMAAQTRVLMTDTTMRDGHQSLLATRMRSIDMIKVTPAYAANLGGLFSVECWGGATFDVAYRFLQECPWQRLRDIRARLPNVMTQMLLRASNGVGYTNYPDNVVQEFVRQAAETGVDVFRVFDSLNWVENMRVAMDAVIEANKVCEGTICYTGDLLDPDRSKYDLNYYVGMGRALRDAGAHVLGLKDMAGLLKPAAARVLVKALKEEVGLPIHFHTHDTSGIAGATVLAACDAGVDAVDAAMDAFSGGTSQPCLGSIVEALKHTDRDTGLDIAAIREISDYWGHVRQQYSAFESGLPSPASEVYLHEMPGGQFTNLKAQARSMGLEERWSEVAQAYADANRMFGDIVKVTPSSKVVGDMALMMVAQGLTREEVEDPEVEVSFPDSVVDMLKGNLGQPHGGWPEPILKKVLKGEAPSTERPGAHLPPVDIAAAREKLLSEIKQGDDDPLDTAVDAEDLNGYLMYPKVFTDYRARHRIYGPVRTLPTRTFFYGMEPGEEISAEIDPGKTLEIRLSAVGETSDDGDAKVFFELNGQPRVIRVANRAVKAKTATRPKAQDGNPAHVGAPMPGSVASVAVSAGQKVKPGDLLVTIEAMKMETGLHADRAATVKAVHVGPGAQIEAKDLLVELED

SEQ ID NO: 4 - protein, 1154 aa, Rhizobium etli
MPISKILVANRSEIAIRVFRAANELGIKTVAIWAEEDKLALHRFKADESYQVGRGPHLARDLGPIESYLSIDEVIRVAKLSGADAIHPGYGLLSESPEFVDACNKAGIIFIGPKADTMRQLGNKVAARNLAISVGVPVVPATEPLPDDMAEVAKMAAAIGYPVMLKASWGGGGRGMRVIRSEADLAKEVTEAKREAMAAFGKDEVYLEKLVERARHVESQILGDTHGNVVHLFERDCSVQRRNQKVVERAPAPYLSEAQRQELAAYSLKIAGATNYIGAGTVEYLMDADTGKFYFIEVNPRIQVEHTVTEVVTGIDIVKAQIHILDGAAIGTPQSGVPNQEDIRLNGHALQCRVTTEDPEHNFIPDYGRITAYRSASGFGIRLDGGTSYSGAIITRYYDPLLVKVTAWAPNPLEAISRMDRALREFRIRGVATNLTFLEAIIGHPKFRDNSYTTRFIDTTPELFQQVKRQDRATKLLTYLADVTVNGHPEAKDRPKPLENAARPVVPYANGNGVKDGTKQLLDTLGPKKFGEWMRNEKRVLLTDTTMRDGHQSLLATRMRTYDIARIAGTYSHALPNLLSLECWGGATFDVSMRFLTEDPWERLALIREGAPNLLLQMLLRGANGVGYTNYPDNVVKYFVRQAAKGGIDLFRVFDCLNWVENMRVSMDAIAEENKLCEAAICYTGDILNSARPKYDLKYYTNLAVELEKAGAHIIAVKDMAGLLKPAAAKVLFKALREATGLPIHFHTHDTSGIAAATVLAAVEAGVDAVDAAMDALSGNTSQPCLGSIVEALSGSERDPGLDPAWIRRISFYWEAVRNQYAAFESDLKGPASEVYLHEMPGGQFTNLKEQARSLGLETRWHQVAQAYADANQMFGDIVKVTPSSKVVGDMALMMVSQDLTVADVVSPDREVSFPESVVSMLKGDLGQPPSGWPEALQKKALKGEKPYTVRPGSLLKEADLDAERKVIEKKLEREVSDFEFASYLMYPKVFTDFALASDTYGPVSVLPTPAYFYGLADGEELFADIEKGKTLVIVNQAVSATDSQGMVTVFFELNGQPRRIKVPDRAHGATGAAVRRKAEPGNAAHVGAPMPGVISRVFVSSGQAVNAGDVLVSIEAMKMETAIHAEKDGTIAEVLVKAGDQIDAKDLLAVYGG

SEQ ID NO: 5 - protein, 602 aa, Pseudomonas fluorescens
MTKKIFVTDTILRDAHQSLLATRMRTEDMLPICDKLDKVGYWSLECWGGATFDACVRFLKEDPWERLRQLRAALPNTRLQMLLRGQNLLGYRHYSDDVVKAFVAKAAVNGIDVFRIFDAMNDVRNLRVAIEAVKAAGKHAQGTIAYTTSPVHTIDAFVAQAKQMEAMGCDSVAIKDMAGLLTPYATGELVRALKAEQSLPVFIHSHDTAGLAAMCQLKAIENGADHIDTAISSFASGTSHPGTESMVAALKGTEFDTGLNLELLQEIGLYFYAVRKKYHQFESEFTAVDTRVQVNQVPGGMISNLANQLKEQGALNRMGEVLAEIPRVREDLGFPPLVTPTSQIVGTQAFFNVLAGERYKTITNEVKLYLQGGYGKAPGTVNEKLRRQAIGSEEVIDVRPADLLKPEMTKLRADIGALAKSEEDVLTFAMFPDIGRKFLEERAAGTLTPEVLLPIPEAGKVASAGGEGVPTEFVIDVHGETYRVDITGVGVKAEGKRHFYLSIDGMPEEVVFEPLNEFVGGGSSKRKQASAPGHVSTTMPGNIVDVLVKEGDTVKAGQAVLITEAMKMETEVQAAIAGKVTAIHVAKGDRVNPGEILIEIEG

SEQ ID NO: 6 - protein, 481 aa, Pseudomonas fluorescens
MVPPAQGNLQVITKILIANRGEIAVRIVRACAEMGIRSVAIYSDADRHALHVKRADEAHSIGAEPLAGYLNPRKLVNLAVETGCDALHPGYGFLSENAELADICAERGIKFIGPSAEVIRRMGDKTEARRSMIKAGVPVTPGTEGNVSGIEEALSEGDRIGYPVMLKATSGGGGRGIRRCNSREELEQNFPRVISEATKAFGSAEVFLEKCIVNPKHIEAQILGDSFGNVVHLFERDCSIQRRNQKLIEIAPSPQLTPEQRAYIGDLSVRAAKAVGYENAGTVEFLLAEGEVYFMEMNTRVQVEHTITEEITGIDIVREQIRIASGLPLSVKQEDIQHRGFALQFRINAEDPKNNFLPSFGKITRYYAPGGPGVRTDTAIYTGYTIPPFYDSMCLKLVVWALTWEEAMDRGLRALDDMRLQGVKTTAAYYQEILRNPEFRSGQFNTSFVESHPELTNYSIKRKPEELALAIAAAIAAHAGL

SEQ ID NO: 7 - protein, 1140 aa, Corynebacterium glutamicum
MSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 8 - protein, 1152 aa, Sinorhizobium meliloti
MSISKILVANRSEIAIRVFRAANELGLKTVAIWAEEDKLALHRFKADESYQVGRGPHLPRDLGPIMSYLSIDEVIRVAKLSGADAIHPGYGLLSESPEFAEACAANGITFIGPKPETMRQLGNKVAARNLAISIGVPVVPATEPLPDDPEEIKRLAEEIGYPVMLKASWGGGGRGMRAIRDPKDLIREVTEAKREAKAAFGKDEVYLEKLVERARHVESQILGDTHGNVVHLFERDCSIQRRNQKVVERAPAPYLNDAQRQELADYSLKIARATNYIGAGTVEYLMDSDTGKFYFIEVNPRIQVEHTVTEVVTGIDIVKAQIHILDGFAIGAPESGVPRQEDIRLNGHALQCRITTEDPEQNFIPDYGRITAYRGATGFGIRLDGGTAYSGAVITRYYDPLLEKVTAWAPNPGEAIQRMIRALREFRIRGVATNLTFLEAIISHPKFHDNSYTTRFIDTTPELFQQVKRQDRATKLLTYLADVTVNGHPEVKGRPKPSDDIAAPVVPFTGGDVKPGTKQRLDQLGPKKFAEWVKAQPEVLITDTTMRDGHQSLLATRMRTYDIARIAGTYARALPNLFSLECWGGATFDVSMRFLTEDPWERLAMVREGAPNLLLQMLLRGANGVGYKNYPDNVVKYFVRQAAKGGIDVFRVFDCLNWVENMRVAMDAVAEEDRICEAAICYTGDILNSARPKYDLKYYTALAAELEKAGAHMIAVKDMAGLLKPAAARVLFKALKEATGLPIHFHTHDTSGIAAATVLAAVESGVDVVDAAMDALSGNTSQPCLGSIVEALSGSERDPGLDPEWIRRISFYWEAVRHQYAAFESDLKGPASEVYLHEMPGGQFTNLKEQARSLGLETRWHEVAQAYADANRMFGDIVKVTPSSKVVGDMALMMVSQDLTVADVENPGKDIAFPESVVSMLKGDLGQPPGGWPEALQKKALKGEEPYDARPGSLLEDADLDAERKGIEEKLGREVTDFEFASYLMYPKVFTDYAVACETYGPVSVLPTPAYFYGMAPGEELFADIEKGKTLVILNQAQGEIDEKGMVKMFFEMNGQPRSIKVPDRNRGASAAVRRKAEAGNAAHLGAPMPGVISTVAVASGQSVKAGDVLLSIEAMKMETALHAEKDGVISEVLVRAGDQIDAKDLLVVFGG

SEQ ID NO: 9 - DNA, 2652 bp, Escherichia coli
atgaacgaacaatattccgcattgcgtagtaatgtcagtatgctcggcaaagtgctgggagaaaccatcaaggatgcgttgggagaacacattcttgaacgcgtagaaactatccgtaagttgtcgaaatcttcacgcgctggcaatgatgctaaccgccaggagttgctcaccaccttacaaaatttgtcgaacgacgagctgctgcccgttgcgcgtgcgtttagtcagttcctgaacctggccaacaccgccgagcaataccacagcatttcgccgaaaggcgaagctgccagcaacccggaagtgatcgcccgcaccctgcgtaaactgaaaaaccagccggaactgagcgaagacaccatcaaaaaagcagtggaatcgctgtcgctggaactggtcctcacggctcacccaaccgaaattacccgtcgtacactgatccacaaaatggtggaagtgaacgcctgtttaaaacagctcgataacaaagatatcgctgactacgaacacaaccagctgatgcgtcgcctgcgccagttgatcgcccagtcatggcataccgatgaaatccgtaagctgcgtccaagcccggtagatgaagccaaatggggctttgccgtagtggaaaacagcctgtggcaaggcgtaccaaattacctgcgcgaactgaacgaacaactggaagagaacctcggctacaaactgcccgtcgaatttgttccggtccgttttacttcgtggatgggcggcgaccgcgacggcaacccgaacgtcactgccgatatcacccgccacgtcctgctactcagccgctggaaagccaccgatttgttcctgaaagatattcaggtgctggtttctgaactgtcgatggttgaagcgacccctgaactgctggcgctggttggcgaagaaggtgccgcagaaccgtatcgctatctgatgaaaaacctgcgttctcgcctgatggcgacacaggcatggctggaagcgcgcctgaaaggcgaagaactgccaaaaccagaaggcctgctgacacaaaacgaagaactgtgggaaccgctctacgcttgctaccagtcacttcaggcgtgtggcatgggtattatcgccaacggcgatctgctcgacaccctgcgccgcgtgaaatgtttcggcgtaccgctggtccgtattgatatccgtcaggagagcacgcgtcataccgaagcgctgggcgagctgacccgctacctcggtatcggcgactacgaaagctggtcagaggccgacaaacaggcgttcctgatccgcgaactgaactccaaacgtccgcttctgccgcgcaactggcaaccaagcgccgaaacgcgcgaagtgctcgatacctgccaggtgattgccgaagcaccgcaaggctccattgccgcctacgtgatctcgatggcgaaaacgccgtccgacgtactggctgtccacctgctgctgaaagaagcgggtatcgggtttgcgatgccggttgctccgctgtttgaaaccctcgatgatctgaacaacgccaacgatgtcatgacccagctgctcaatattgactggtatcgtggcctgattcagggcaaacagatggtgatgattggctattccgactcagcaaaagatgcgggagtgatggcagcttcctgggcgcaatatcaggcacaggatgcattaatcaaaacctgcgaaaaagcgggtattgagctgacgttgttccacggtcgcggcggttccattggtcgcggcggcgcacctgctcatgcggcgctgctgtcacaaccgccaggaagcctgaaaggcggcctgcgcgtaaccgaacagggcgagatgatccgctttaaatatggtctgccagaaatcaccgtcagcagcctgtcgctttataccggggcgattctggaagccaacctgctgccaccgccggagccgaaagagagctggcgtcgcattatggatgaactgtcagtcatctcctgcgatgtctaccgcggctacgtacgtgaaaacaaagattttgtgccttacttccgctccgctacgccggaacaagaactgggcaaactgccgttgggttcacgtccggcgaaacgtcgcccaaccggcggcgtcgagtcactacgcgccattccgtggatcttcgcctggacgcaaaaccgtctgatgctccccgcctggctgggtgcaggtacggcgctgcaaaaagtggtcgaagacggcaaacagagcgagctggaggctatgtgccgcgattggccattcttctcgacgcgtctcggcatgctggagatggtcttcgccaaagcagacctgtggctggcggaatactatgaccaacgcctggtagacaaagcactgtggccgttaggtaaagagttacgcaacctgcaagaagaagacatcaaagtggtgctggcgattgccaacgattcccatctgatggccgatctgccgtggattgcagagtctattcagctacggaatatttacaccgacccgctgaacgtattgcaggccgagttgctgcaccgctcccgccaggcagaaaaagaaggccaggaaccggatcctcgcgtcgaacaagcgttaatggtcactattgccgggattgcggcaggtatgcgtaataccggctaa

SEQ ID NO: 10 - protein, 883 aa, Escherichia coli
MNEQYSALRSNVSMLGKVLGETIKDALGEHILERVETIRKLSKSSRAGNDANRQELLTTLQNLSNDELLPVARAFSQFLNLANTAEQYHSISPKGEAASNPEVIARTLRKLKNQPELSEDTIKKAVESLSLELVLTAHPTEITRRTLIHKMVEVNACLKQLDNKDIADYEHNQLMRRLRQLIAQSWHTDEIRKLRPSPVDEAKWGFAVVENSLWQGVPNYLRELNEQLEENLGYKLPVEFVPVRFTSWMGGDRDGNPNVTADITRHVLLLSRWKATDLFLKDIQVLVSELSMVEATPELLALVGEEGAAEPYRYLMKNLRSRLMATQAWLEARLKGEELPKPEGLLTQNEELWEPLYACYQSLQACGMGIIANGDLLDTLRRVKCFGVPLVRIDIRQESTRHTEALGELTRYLGIGDYESWSEADKQAFLIRELNSKRPLLPRNWQPSAETREVLDTCQVIAEAPQGSIAAYVISMAKTPSDVLAVHLLLKEAGIGFAMPVAPLFETLDDLNNANDVMTQLLNIDWYRGLIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITVSSLSLYTGAILEANLLPPPEPKESWRRIMDELSVISCDVYRGYVRENKDFVPYFRSATPEQELGKLPLGSRPAKRRPTGGVESLRAIPWIFAWTQNRLMLPAWLGAGTALQKVVEDGKQSELEAMCRDWPFFSTRLGMLEMVFAKADLWLAEYYDQRLVDKALWPLGKELRNLQEEDIKVVLAIANDSHLMADLPWIAESIQLRNIYTDPLNVLQAELLHRSRQAEKEGQEPDPRVEQALMVTIAGIAAGMRNTG

SEQ ID NO: 11 - protein, 483 aa, Methanobacterium thermoautotrophicum
MKVPRCMSTQHPDNVNPPFFAEEPELGGEDEIREAYYVFSHLGCDEQMWDCEGKEVDNYVVKKLLTKYQAFFRDHVLGEDLRLTLRVPNPTVERAEAKILLETLESIPRSYDTASLFYGMDAAPVFEVILPMTSSSSCLNRIHSYYLDFVKGKERLQLADGVTVKEWIGEFRPDEINVIPLFEDHEGMLNAAKITGEYLDGKDIQEQRVFLARSDPAMNYGMISATLLNRIALSDFRDLEEESGVKLYPIIGMGSAPFRGNLRPDNVEDVTWEYRGAYTFTVQSSFKYDHEPSDVIRGIKKLRSVKPGRAAEIERESVLEIISAYCREYRRQVMDLVDIINRVARYVPGRRKRKLHIGLFGYSRSMGNVSLPRAITFTAALYSLGVPPELLGFNALSSGDLEFIEEVYPGLGRDLHDAARYANPESPFLSPEVKSSFEEYLEPEYDEGHMKTTEEIIRALRINRTANLQELILEAASQRKFLG

SEQ ID NO: 12 - protein, 537 aa, Clostridium perfringens
MKIPCSMMTQHPDNVETYISIQQEPAEAIKGLTPQDKGGLGIEEVMIDFEGKLTPYHQTSQIALGLISNGIIPGKDVRVTPRIPNANKESVFRQLMSIMSIIETNVQSKELTGTPAISEVVVPMIETGKEISEFQDRVNSVVDMGNKNYKTKLDLNSVRIIPLVEDVPALANIDRILDEHYEIEKSKGHILKDLRIMIARSDTAMSYGLISGVLSVLMAVDGAYKWGEKHGVTISPILGCGSLPFRGHFSEENIDEILATYSGIKTFTFQSALRYDHGEEATKHAVRELKEKIAQSKPRNFSEEDKDLMKEFIGICSKHYLQTFLKVIDTVSFVSDFIPKNRDRLTKAKTGLEYNREVANLDNVADLVKDEVLKQEILSIDNSKEYAVPRAISFTGAMYTLGMPPELMGMGRALNEIKTKYGQEGIDKLLEIYPILRKDLAFAARFANGGVSKKIIDEEARQEYKEDMKYVNEILNLGLDYDFLNENEFYHTLLKTTKPIIMHLMGLEENVMRNSTEELKILNEWIVRMGKVRGSIG

SEQ ID NO: 13 - DNA, 1260 bp, Issatchenkia orientalis
atgtccagaggcttctttactgagaacattacgcaattgccaccagaccctttgtttggtcttaaggccaggttcagcaatgactcacgtgaaaacaaggtcgatttaggtattggggcatatagggacgacaacggtaagccatggatcttaccatctgtcaggttggccgaaaacttgattcagaactccccagactacaaccatgagtacctaccaatcggtggacttgctgatttcacttctgctgcggcaagagttgtatttggaggcgattctaaagccatttcgcaaaaccgtcttgtctccatccagagtttgtcaggtacaggtgccttacatgttgctggtctatttatcaagcgccaatacaagtctcttgatggcacttccgaagaccctctaatatatctatcggaacctacatgggccaaccacgttcaaatctttgaagttattggtctcaagcctgtattctatccatattggcatgccgcaagcaagaccttggatctgaagggctacttaaaggcaataaacgatgctccagaagggtcggtttttgtattgcatgcaacggctcataaccctactggtttggatccaacacaagaacaatggatggagattttggccgctataagtgccaaaaagcatctgccattatttgattgtgcatatcagggtttcacctccgggtctctagatagagatgcttgggctgttcgagaagctgtcaacaatgacaagtacgaattcccgggaattattgtctgtcaatcgtttgcgaaaaatgttggcatgtatggtgaacggattggtgcagttcatattgttctacctgaatcagacgcttccctaaacagcgccatcttctcccaattgcaaaagacaatcagatcggagatttccaatccaccaggatacggtgcaaagattgtgtctaaagttttgaacactccggaactttacaaacagtgggagcaagatttgatcaccatgtcttcgagaatcactgcaatgagaaaggagctagtaaatgagctcgagcgtcttggaacccctggcacttggagacacatcaccgagcaacagggtatgttttcctttactggtttgaacccggagcaggttgccaagctagagaaggagcatggtgtttatcttgttcgtagtggacgtgcaagtattgcaggcctcaacatgggaaacgtcaagtatgttgccaaggccattgactctgtcgtgagagacctttag

SEQ ID NO: 14 - protein, 419 aa, Issatchenkia orientalis
MSRGFFTENITQLPPDPLFGLKARFSNDSRENKVDLGIGAYRDDNGKPWILPSVRLAENLIQNSPDYNHEYLPIGGLADFTSAAARVVFGGDSKAISQNRLVSIQSLSGTGALHVAGLFIKRQYKSLDGTSEDPLIYLSEPTWANHVQIFEVIGLKPVFYPYWHAASKTLDLKGYLKAINDAPEGSVFVLHATAHNPTGLDPTQEQWMEILAAISAKKHLPLFDCAYQGFTSGSLDRDAWAVREAVNNDKYEFPGIIVCQSFAKNVGMYGERIGAVHIVLPESDASLNSAIFSQLQKTIRSEISNPPGYGAKIVSKVLNTPELYKQWEQDLITMSSRITAMRKELVNELERLGTPGTWRHITEQQGMFSFTGLNPEQVAKLEKEHGVYLVRSGRASIAGLNMGNVKYVAKAIDSVVRDL

SEQ ID NO: 15 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 16 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 17 - protein, 139 aa, Streptomyces avermitilis
MLRTMFKSKIHRATVTQADLHYVGSVTIDADLLDAADLLPGELVHIVDITNGARLETYVIEGERGSGVVGINGAAAHLVHPGDLVIIISYAQVSDAEARALRPRVVHVDRDNRVVALGADPAEPVPGSDQARSPQAVTA

SEQ ID NO: 18 - protein, 127 aa, Clostridium acetobutylicum
MHLNMLKSKIHRATVVQADLNYVGSITIDRNLMDKANILEYEKVEIANINNGARFETYVIAGEAGSGIICLNGAAARCAQAGDKVIIMCYCSLTPEEASEHRPKVVFVNDDNSISNVTEYEKHGTIG

SEQ ID NO: 19 - DNA, 1404 bp, Issatchenkia orientalis
atgtctattagtgaaaaatattttcctcaagaacctcaatctcctgaattgaaaactgcaattccaggtcctcaatcaaaggcaaagctcgaggaattatctgctgtctatgatacaaaggctgcatattttgttaccgactactacaaatctcttggtaactatattgtggatgcagatggcaacaagctactagattcttattgccaaatctcttctatcgcattgggttacaataatccagcattattaaaagtagcacattctgatgaaatgacagttgctttatgtaacagacctgctttggcatgttttccatccactgattactatgaaatactaaagaagggattgttgtccgttgctccaaagggattagataaggtttgtactgcacacacgggatctgatgccaatgaaatggcatttaaggctgcatttttgtttcaagcaagtaagaagagaggtgacaaaccatttaccagcgaagagctggaatctgtcatggagaacaagttgccaggcacctctgacatggttatcctgtcatttgaaaaagggttccatggtagattgtttggatctttatctaccactagatctaaagctattcacaaactggatattcctgcgtttgaatggccaaaggctccattccctcagttaaagtatcctctggatcaattccaagctgaaaacaaagcagaagaagaaagatgtttgaaggctttagaggaaattattgtcaactctcctgccaaaattgcagctgcaatcattgaaccggtccaatctgaaggtggtgataatcatgcttcaccagaattcttccaaggtattagagaaatcaccaaaaagcacggtgtcattcttattgttgatgaagttcaaacaggaggtggtgcttctggtaagatgtggttacatgaacactatggcattgtcccagacatcatgactttttctaaaaaaatgcaaaatgcaggtttctttttcagtgaagcaggtcttgctggggaccaaccattcagacaattcaatacctggtgcggtgatccatcaaaagctctaattgcaagaaccataattgaagaaattaaagataagaacctattgactagtgttaccgaaacaggtgactacctatattcaaagctcgaagcaatttcagcaaagtatgacaaaatgatcaacttgagaggtaagggaagaggtttctttattgcatttgatgccccaacaccggagttaagaaacaaatttattgctgaatgtaagaaattaggtttaaacattggtggatgcggtgaacaaggtgttagattgagacctgcattagtttttgaaaagaagcatgctgatatcttagcctccattattgatcaagctttttccaaaatttaa

SEQ ID NO: 20 - protein, 467 aa, Issatchenkia orientalis
MSISEKYFPQEPQSPELKTAIPGPQSKAKLEELSAVYDTKAAYFVTDYYKSLGNYIVDADGNKLLDSYCQISSIALGYNNPALLKVAHSDEMTVALCNRPALACFPSTDYYEILKKGLLSVAPKGLDKVCTAHTGSDANEMAFKAAFLFQASKKRGDKPFTSEELESVMENKLPGTSDMVILSFEKGFHGRLFGSLSTTRSKAIHKLDIPAFEWPKAPFPQLKYPLDQFQAENKAEEERCLKALEEIIVNSPAKIAAAIIEPVQSEGGDNHASPEFFQGIREITKKHGVILIVDEVQTGGGASGKMWLHEHYGIVPDIMTFSKKMQNAGFFFSEAGLAGDQPFRQFNTWCGDPSKALIARTIIEEIKDKNLLTSVTETGDYLYSKLEAISAKYDKMINLRGKGRGFFIAFDAPTPELRNKFIAECKKLGLNIGGCGEQGVRLRPALVFEKKHADILASIIDQAFSKI

SEQ ID NO: 21 - protein, 475 aa, Saccharomyces kluyveri
MPSYSVAELYYPDEPTEPKISTSSYPGPKAKQELEKLSNVFDTRAAYLLADYYKSRGNYIVDQDGNVLLDVYAQISSIALGYNNPEILKVAKSDAMSVALANRPALACFPSNDYGQLLEDGLLKAAPQGQDKIWTALSGSDANETAFKACFMYQAAKKRNGRSFSTEELESVMDNQLPGTSEMVICSFEKGFHGRLFGSLSTTRSKPIHKLDIPAFNWPKAPFPDLKYPLEENKEANKAEESSCIEKFSQIVQEWQGKIAAVIIEPIQSEGGDNHASSDFFQKLREITIENGILMIVDEVQTGVGATGKMWAHEHWNLSNPPDLVTFSKKFQAAGFYYHDPKLQPDQPFRQFNTWCGDPSKALIAKVIYEEIVKHDLVTRTAEVGNYLFNRLEKLFEGKNYIQNLRGKGQGTYIAFDFGTSSERDSFLSRLRCNGANVAGCGDSAVRLRPSLTFEEKHADVLVSIFDKTLRQLYG

SEQ ID NO: 22 - protein, 451 aa, Streptomyces avermitilis
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 23 - protein, 419 aa, Streptomyces avermitilis
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 24 - protein, 471 aa, Saccharomyces cerevisiae
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 25 - DNA, 813 bp, Issatchenkia orientalis
atgtttggtaatatttcccaaagacttgcaggcaagaacatcctaattacaggtgcgtccactggtatcggataccatacagcaaagtattttgcagaagctgcaaatggagacttgaagttggttttggctgcaagaagaaaggagaagctggaggcactaaaggcagacttgcttgccaagtatccatccatcaaagtccatattgagagtttggatgtctccaaaacggaaaccattgcacctttcttaaaaggtttacctgaggaattttcaattgtcgacgtgttggtcaacaatgcaggtaaggcgcttggtttggatccaattggctctgtcgatccaaaggacgtggatgaaatgttccagaccaatgttttgggtatgattcaattgacccagttggttgtacagcaaatgaaggagagaaactccggggacattgtccaactaggttcagtggctggtagaaacccatacccaggtggtggtatctactgtgcctccaaggccgcattgagatcttttacacatgtattgagagaggaattgattaataccaagattagagtgattgaaatcgagcctggaaatgttgcaactgaggaattttctttgaccagattcaaaggtgataagtccaaggccgaaaaggtctatgagggaaccgagccattgtatggtaccgatattgcagaattgattctatttgcagtttctagacctcaaaacactgttattgcagaaacacttgtttttgctagtaaccaagcttctgcttaccatattttcagaggatcattagataaatag

SEQ ID NO: 26 - protein, 270 aa, Issatchenkia orientalis
MFGNISQRLAGKNILITGASTGIGYHTAKYFAEAANGDLKLVLAARRKEKLEALKADLLAKYPSIKVHIESLDVSKTETIAPFLKGLPEEFSIVDVLVNNAGKALGLDPIGSVDPKDVDEMFQTNVLGMIQLTQLVVQQMKERNSGDIVQLGSVAGRNPYPGGGIYCASKAALRSFTHVLREELINTKIRVIEIEPGNVATEEFSLTRFKGDKSKAEKVYEGTEPLYGTDIAELILFAVSRPQNTVIAETLVFASNQASAYHIFRGSLDK

SEQ ID NO: 27 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 28 - protein, 298 aa, Alcaligenes faecalis
MSNTIAFIGLGHMGKPMALNLLKAGHSLNVFDLNAQAMQELQAAGAQVGESAVQIAQDAQMVFTMLPAGRHVRQVYEGENGLLQTVAPGTVLVDCSTIDAQTSQDLAAKASKLGLFMLDAPVSGGTGGAIAGTLTFMVGGEDQALEKARPYLDAMGKNIFHAGKAGAGQVAKICNNMLLGILMAGTAEALALGVAHGLDPAVLSTIMARSSGRNWATELYNPWPGVMPDVPASRDYQGGFATGLMLKDLGLAADAAVSQNSATPLGELARNLFALHAAQGQNAGLDFSSILNLYRQKH

SEQ ID NO: 29 - protein, 314 aa, Metallosphaera sedula
MTEKVSVVGAGVIGVGWATLFASKGYSVSLYTEKKETLDKGIEKLRNYVQVMKNNSQITEDVNTVISRVSPTTNLDEAVRGANFVIEAVIEDYDAKKKIFGYLDSVLDKEVILASSTSGLLITEVQKAMSKHPERAVIAHPWNPPHLLPLVEIVPGEKTSMEVVERTKSLMEKLDRIVVVLKKEIPGFIGNRLAFALFREAVYLVDEGVATVEDIDKVMTAAIGLRWAFMGPFLTYHLGGGEGGLEYFFNRGFGYGANEWMHTLAKYDKFPYTGVTKAIQQMKEYSFIKGKTFQEISKWRDEKLLKVYKLVWEK

SEQ ID NO: 30 - protein, 295 aa, Pseudomonas putida
MRIAFIGLGNMGAPMARNLIKAGHQLNLFDLNKAVLAELAELGGQISPSPKDAAANSELVITMLPAAAHVRSVYLNEDGVLAGIRPGTPTVDCSTIDPQTARDVSKAAAAKGVDMGDAPVSGGTGGAAAGTLTFMVGASTELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 31 - protein, 295 aa, Pseudomonas putida
MRIAFIGLGNMGAPMARNLIKAGHQLNLFDLNKTVLAELAELGGQISPSPKDAAASSELVITMLPAAAHVRSVYLNDDGVLAGIRPGTPTVDCSTIDPQTARDVSKAAAAKGVDMGDAPVSGGTGGAAAGTLTFMVGASAELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 32 - protein, 298 aa, Pseudomonas aeruginosa
MTDIAFLGLGNMGGPMAANLLKAGHRVNVFDLQPKAVLGLVEQGAQGADSALQCCEGAEVVISMLPAGQHVESLYLGDDGLLARVAGKPLLIDCSTIAPETARKVAEAAAAKGLTLLDAPVSGGVGGARAGTLSFIVGGPAEGFARARPVLENMGRNIFHAGDHGAGQVAKICNNMLLGILMAGTAEALALGVKNGLDPAVLSEVMKQSSGGNWALNLYNPWPGVMPQAPASNGYAGGFQVRLMNKDLGLALANAQAVQASTPLGALARNLFSLHAQADAEHEGLDFSSIQKLYRGKD

SEQ ID NO: 33 - protein, 382 aa, Ralstonia eutropha
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 34 - protein, 371 aa, Clostridium kluyveri
MKLLKLAPDVYKFDTAEEFMKYFKVGKGDFILTNEFLYKPFLEKFNDGADAVFQEKYGLGEPSDEMINNIIKDIGDKQYNRIIAVGGGSVIDIAKILSLKYTDDSLDLFEGKVPLVKNKELIIVPTTCGTGSEVTNVSVAELKRRHTKKGIASDELYATYAVLVPEFIKGLPYKFFVTSSVDALIHATEAYVSPNANPYTDMFSVKAMELILNGYMQMVEKGNDYRVEIIEDFVIGSNYAGIAFGNAGVGAVHALSYPIGGNYHVPHGEANYLFFTEIFKTYYEKNPNGKIKDVNKLLAGILKCDESEAYDSLSQLLDKLLSRKPLREYGMKEEEIETFADSVIEGQQRLLVNNYEPFSREDIVNTYKKLY

SEQ ID NO: 35 - protein, 538 aa, Mannheimia succiniciproducens
MTDLNQLTQELGALGIHDVQEVVYNPSYELLFAEETKPGLEGYEKGTVTNQGAVAVNTGIFTGRSPKDKYIVLDDKTKDTVWWTSEKVKNDNKPMSQDTWNSLKGLVADQLSGKRLFVVDAFCGANKDTRLAVRVVTEVAWQAHFVTNMFIRPSAEELKGFKPDFVVMNGAKCTNPNWKEQGLNSENFVAFNITEGVQLIGGTWYGGEMKKGMFSMMNYFLPLRGIASMHCSANVGKDGDTAIFFGLSGTGKTTLSTDPKRQLIGDDEHGWDDEGVFNFEGGCYAKTINLSAENEPDIYGAIKRDALLENVVVLDNGDVDYADGSKTENTRVSYPIYHIQNIVKPVSKAGPATKVIFLSADAFGVLPPVSKLTPEQTKYYFLSGFTAKLAGTERGITEPTPTFSACFGAAFLSLHPTQYAEVLVKRMQESGAEAYLVNTGWNGTGKRISIKDTRGIIDAILDGSIDKAEMGSLPIFDFSIPKALPGVNPAILDPRDTYADKAQWEEKAQDLAGRFVKNFEKYTGTAEGQALVAAGPKA

SEQ ID NO: 36 - protein, 532 aa, Anaerobiospirillum succiniciproducens
MSLSESLAKYGITGATNIVHNPSHEELFAAETQASLEGFEKGTVTEMGAVNVMTGVYTGRSPKDKFIVKNEASKEIWWTSDEFKNDNKPVTEEAWAQLKALAGKELSNKPLYVVDLFCGANENTRLKIRFVMEVAWQAHFVTNMFIRPTEEELKGFEPDFVVLNASKAKVENFKELGLNSETAVVFNLAEKMQIILNTWYGGEMKKGMFSMMNFYLPLQGIAAMHCSANTDLEGKNTAIFFGLSGTGKTTLSTDPKRLLIGDDEHGWDDDGVFNFEGGCYAKVINLSKENEPDIWGAIKRNALLENVTVDANGKVDFADKSVTENTRVSYPIFHIKNIVKPVSKAPAAKRVIFLSADAFGVLPPVSILSKEQTKYYFLSGFTAKLAGTERGITEPTPTFSSCFGAAFLTLPPTKYAEVLVKRMEASGAKAYLVNTGWNGTGKRISIKDTRGIIDAILDGSIDTANTATIPYFNFTVPTELKGVDTKILDPRNTYADASEWEVKAKDLAERFQKNFKKFESLGGDLVKAGPQL

SEQ ID NO: 37 - protein, 538 aa, Actinobacillus succinogenes
MTDLNKLVKELNDLGLTDVKEIVYNPSYEQLFEEETKPGLEGFDKGTLTTLGAVAVDTGIFTGRSPKDKYIVCDETTKDTVWWNSEAAKNDNKPMTQETWKSLRELVAKQLSGKRLFVVEGYCGASEKHRIGVRMVTEVAWQAHFVKNMFIRPTDEELKNFKADFTVLNGAKCTNPNWKEQGLNSENFVAFNITEGIQLIGGTWYGGEMKKGMFSMMNYFLPLKGVASMHCSANVGKDGDVAIFFGLSGTGKTTLSTDPKRQLIGDDEHGWDESGVFNFEGGCYAKTINLSQENEPDIYGAIRRDALLENVVVRADGSVDFDDGSKTENTRVSYPIYHIDNIVRPVSKAGHATKVIFLTADAFGVLPPVSKLTPEQTEYYFLSGFTAKLAGTERGVTEPTPTFSACFGAAFLSLHPIQYADVLVERMKASGAEAYLVNTGWNGTGKRISIKDTRGIIDAILDGSIEKAEMGELPIFNLAIPKALPGVDPAILDPRDTYADKAQWQVKAEDLANRFVKNFVKYTANPEAAKLVGAGPKA

SEQ ID NO: 38 - protein, 618 aa, Ralstonia eutropha
MNHPSMQGTTALNVPAWVRNQKLVAWVAEIAALTKPERIHWCDGSQEEYDRLCEQMVAAGTLKRLNPAKRKNSYLALSDPSDVARVEDRTFICSQKKEDAGPTNNWVAPAEMRTTLNGLFDGCMRGRTLYVVPFSMGPLGSPIAHIGVELSDSPYVAVNMRIMTRMGKAVYDVLGTDGDFVPCVHTVGKPLAAGEKDVPWPCNPTKYIVHFPESREIWSFGSGYGGNALLGKKCFALRIASTMGRDEGWLAEHMLILGVTSPEGKKFHVAAAFPSACGKTNFAMLIPPKGFEGWKVTTIGDDIAWIKPGKDGRLYAINPEAGYFGVAPGTSEKTNFNAMATLKENVIFTNVALTDDGDVWWEGMTKEAPAHLTDWQGKDWTPEIAKATGAKAAHPNARFTAPASQCPSIDENWDNPAGVPIDAFIFGGRRSTTVPLVTEARNWTEGVYMAATMGSETTAAAAGQQGVVRRDPFAMLPFCGYNMSDYFGHWLALGQKLEAAGAKLPKIYCVNWFRKDADGNFVWPGFGENMRVLSWMIDRVEGKGEGAEHVFGTSPRYEDLNWSGVEFSVAQFTQVTSIDADAWKQELALHDELFTQLKHNLPQALAEARAALGKRLEG

SEQ ID NO: 39 - protein, 540 aa, Escherichia coli
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIDNIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 40 - protein, 236 aa, Lactococcus lactis
MSEITQLFQYNTLGALMAGLYEGTMTIGELLKHGDLGIGTLDSIDGELIVLDGKAYQAKGDKTIVELTDDIKVPYAAVVPHQAEVVFKQKFTVSDKELEDRIESYFDGQNLFRSIKITGKFPKMHVRMIPRAKSGTKFVEVSQNQPEYTEENIKGTIVGIWTPEMFHGVSVAGYHLHFISEDFTFGGHVLDFIIDNGTVEIGAIDQLNQSFPVQDRKFLFADLDIEALKKDIDVAE

SEQ ID NO: 41 - protein, 239 aa, Streptococcus thermophilus
MSEAIKLFQYNTLGALMAGLYGGTLTVGELLEHGDLGLGTLDSIDGELIVLDGKAYQAKGSEGKVEVVEVSPDEKVPYAAVVPHQAEVIFRQRYEMTDKELEDRIESYYDGVNLFRSIKIKGHFKHMHVRMIPKSNADIKFADVATRQPEYEVDDISGTIVGIWTPEMFHGVSVAGYHLHFISDDLTFGGHVMDFVIENGIIEVGPVDQLDQRFPVQDRQYLFAKFNVDEMRKDITKAE

SEQ ID NO: 42 - protein, 285 aa, Brevibacillus brevis
MKKNIITSITSLALVAGLSLTAFAATTATVPAPPAKQESKPAVAANPAPKNVLFQYSTINALMLGQFEGDLTLKDLKLRGDMGLGTINDLDGEMIQMGTKFYQIDSTGKLSELPESVKTPFAVTTHFEPKEKTTLTNVQDYNQLTKMLEEKFENKNVFYAVKLTGTFKMVKARTVPKQTRPYPQLTEVTKKQSEFEFKNVKGTLIGFYTPNYAAALNVPGFHLHFITEDKTSGGHVLNLQFDNANLEISPIHEFDVQLPHTDDFAHSDLTQVTTSQVHQAESERK

SEQ ID NO: 43 - protein, 259 aa, Enterobacter aerogenes
MMMHSSACDCEASLCETLRGFSAQHPDSVIYQTSLMSALLSGVYVGETTIADLLAHGDFGLGTFNELDGEMIAFSSQVYQLRADGSARAAKPEQKTPFAVMTWFQPQYRKTFNGPVSRQQIHDVIDQQIPSDNLFCVRIDGNFRHAHTRTVPRQTPPYRAMTDVLDDQPVFRFNQREGVLVGFRTPQHMQGINVAGYHEHFITDDRQGGGHLLDYQLESGVLTFGEIHKLMIDLPADSAFLQANLHPSNLDAAIRAVEN

SEQ ID NO: 44 - protein, 1231 aa, Mycobacterium tuberculosis
MANISSPFGQNEWLVEEMYRKFRDDPSSVDPSWHEFLVDYSPEPTSQPAAEPTRVTSPLVAERAAAAAPQAPPKPADTAAAGNGVVAALAAKTAVPPPAEGDEVAVLRGAAAAVVKNMSASLEVPTATSVRAVPAKLLIDNRIVINNQLKRTRGGKISFTHLLGYALVQAVKKFPNMNRHYTEVDGKPTAVTPAHTNLGLAIDLQGKDGKRSLVVAGIKRCETMRFAQFVTAYEDIVRRARDGKLTTEDFAGVTISLTNPGTIGTVHSVPRLMPGQGAIIGVGAMEYPAEFQGASEERIAELGIGKLITLTSTYDHRIIQGAESGDFLRTIHELLLSDGFWDEVFRELSIPYLPVRWSTDNPDSIVDKNARVMNLIAAYRNRGHLMADTDPLRLDKARFRSHPDLEVLTHGLTLWDLDRVFKVDGFAGAQYKKLRDVLGLLRDAYCRHIGVEYAHILDPEQKEWLEQRVETKHVKPTVAQQKYILSKLNAAEAFETFLQTKYVGQKRFSLEGAESVIPMMDAAIDQCAEHGLDEVVIGMPHRGRLNVLANIVGKPYSQIFTEFEGNLNPSQAHGSGDVKYHLGATGLYLQMFGDNDIQVSLTANPSHLEAVDPVLEGLVRAKQDLLDHGSIDSDGQRAFSVVPLMLHGDAAFAGQGVVAETLNLANLPGYRVGGTIHIIVNNQIGFTTAPEYSRSSEYCTDVAKMIGAPIFHVNGDDPEACVWVARLAVDFRQRFKKDVVIDMLCYRRRGHNEGDDPSMTNPYVYDVVDTKRGARKSYTEALIGRGDISMKEAEDALRDYQGQLERVFNEVRELEKHGVQPSESVESDQMIPAGLATAVDKSLLARIGDAFLALPNGFTAHPRVQPVLEKRREMAYEGKIDWAFGELLALGSLVAEGKLVRLSGQDSRRGTFSQRHSVLIDRHTGEEFTPLQLLATNSDGSPTGGKFLVYDSPLSEYAAVGFEYGYTVGNPDAVVLWEAQFGDFVNGAQSIIDEFISSGEAKWGQLSNVVLLLPHGHEGQGPDHTSARIERFLQLWAEGSMTIAMPSTPSNYFHLLRRHALDGIQRPLIVFTPKSMLRHKAAVSEIKDFTEIKFRSVLEEPTYEDGIGDRNKVSRILLTSGKLYYELAARKAKDNRNDLAIVRLEQLAPLPRRRLRETLDRYENVKEFFWVQEEPANQGAWPRFGLELPELLPDKLAGIKRISRRAMSAPSSGSSKVHAVEQQEILDEAFG

SEQ ID NO: 45 - protein, 985 aa, Bradyrhizobium japonicum
MSRQDANAAFALSSFLQGTNATYIDEIYARYEKDPSSVDAEWQEFFKSLKDQPDDVRRNAEGPSWERANWPLTPQDDLTSALDGNWAEVEKAVGGKIAAKAQAKGADISSADLLQATRDSVRALMLIRSYRMRGHFHAKLDPLGIEAPRNREELDPRTYGFSEADFDRKIFLDHVLGLEYGTLREITAICERTYCQTLGVEFMHISNAAQKAWIQERIEGPDKEISFTREGRRAILTKLVEAEGFEKFCDTKFTGTKRFGLDGAESLIPALEQIIKRGGNLGVKEIVLGMPHRGRLNVLTQVMGKAHRALFHEFKGGSANPDAVEGSGDVKYHLGASSDREFDGNRIHLSLTANPSHLEIVDPVVLGKVRAKQDQHGDPPDMRISVMPLLMHGDAAFAGQGVVAECFGLSDLKGYRTGGSVHFIVNNQIGFTTYPRYSRSSPYPSDVAKMIDAPIFHVNGDDPEAVVFAAKVATEFRQKFHKPVVIDMFCYRRHGHNEGDEPAFTQPVMYKKIAAHPSTLELYARRLISEGVMTEGEVDKAKADWRARLDAEFEAGTSYKPNKADWLDGKWAGFKIADQEEDARRGVTGVDITALKDIGRKITKVPDGFRVHRTIQRFLENRSKAIDSGAGIDWATGEALAFCSLLNENHHVRLSGQDSERGTFSQRHSVLIDQEDESRYTPFNHLGHEQGHYEVINSLLSEEAVLGFEYGYSLAEPNTLTLWEAQFGDFANGAQVVFDQFISSGERKWLRMSGLVCLLPHGYEGQGPEHSSARLERYLQMCAEDNMQVVYPTTPANYFHVLRRQLHREIRKPLILMTPKSLLRHKRAVSRLEELAKGTTFHRILYDDAQMLPTDAIKLVPDEKIRRIVLCSGKVYYDLYEEREKRGIDDIYLMRVEQLYPVPLKALVAELSRFKKAEVVWCQEEPRNMGAWHFIEPYLEWVLNQVNGVSRRPRYVGRAASAATATGLMSKHQAQLKAFLDEALS

SEQ ID NO: 46 - protein, 995 aa, Rhizobium loti
MARQDQTNDQFSLTSFLYGGNADYIDALYAAYEDDPASVNPEWQEFFAGLKDDAGDVRRNAKGASWAKPSWPLQANGELVSALDGNWGIVEKHLEKKVKDKAVTNGVVLSDADVHQATRDSVRAIMMIRAYRMRGHLHANLDPLGIAKPLEDYNELSPENYGFTAADYDRPIFLDNVLGLEFGTIRQMLEILTRTYCSTLGVEFMHISDPEEKAWIQARIEGADKEISFTNTGKKAILQKLVEAEGFEQFIDVKYKGTKRFGLDGGEALIPALEQIVKRGGQLGMKEIVLGMAHRGRLNVLSQVMAKPHRAIFHEFKGGSAAPDEVEGSGDVKYHLGASSDREFDGNKVHLSLTANPSHLEIVDPVVMGKARAKQDYLFGRGREEIVPLEERAKVLPLLLHGDAAFAGQGVIAEILGLSGLRGHRVAGTLHFIINNQIGFTTNPRFSRSSPYPSDVAKMIEAPIFHVNGDDPEAVVHATKVAIEFRMKFHKPVVVDMFCYRRFGHNEGDEPAFTQPIMYRNIRTHKTTVQIYADRLIAEGHITQAELDQMKADWRAHLESEWEVGQHYKPNKADWLDGAWSGLRTADNQDEQRRGKTAVPVKTLKEIGKKLTEVPKGFEAHKTIIRFLENRREAIESGEGIDWSTAEALAFGAILLDGNPIRLSGQDSERGTFSQRHSVLYDQRDETRYIPLNNLSAAQAGYEVINSMLSEEAVLGFEYGYSLAEPKALTLWEAQFGDFANGAQVVFDQFISSGERKWLRMSGLVCLLPHGYEGQGPEHSSARLERFLQLCAEDNMQVANCTTPANYFHILRRQLKRDFRKPLILMTPKSLLRHKRAVSTLPEISGESSFHRLLWDDAQLLPNQPIKLTKDSKIRRVVLCSGKVYYDLYEEREKRGINDIYLLRVEQLYPFPAKALITELSRFRNAEMVWCQEEPKNMGAWSFIDPYLEWVLAHIDAKHQRVRYTGRPAAASPATGLMSKHLAQLAALLEDALGE

SEQ ID NO: 47 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 48 - DNA, 1728 bp, Issatchenkia orientalis
atgactgacaaaatctccctaggtacttatctgtttgaaaagttaaaggaagcaggctcttattccatctttggtgttcctggtgatttcaatttggcattgttggaccacgtcaaggaagttgaaggcattagatgggtcggtaacgctaacgagttgaatgccggctacgaagctgatggttatgcaagaatcaatggatttgcatccctaatcaccacctttggtgtcggtgaattgtctgccgtcaatgccattgcaggttcttatgctgaacacgtcccattgatccatattgttggtatgccttccttgtctgctatgaagaacaacttgttgttacaccataccttgggtgacacaagattcgacaacttcaccgaaatgtcaaagaaaatcagtgcaaaggttgaaattgtttacgatttggaatcagctccaaaattaattaataacttgattgaaaccgcttatcacacaaagagaccagtctacttgggacttccttccaactttgctgatgaattggttccagcggcattagttaaggaaaacaagttacatttagaagaacctctaaacaaccccgttgctgaagaagaattcattcataacgttgttgaaatggtcaagaaggcagaaaaaccaatcattctcgttgacgcttgtgctgcaagacataacatttctaaggaagtgagagagttggctaaattgactaaattccctgtcttcaccaccccaatgggtaaatctactgttgatgaagatgatgaagaattctttggcttatacttgggttctctatctgctccagatgttaaggacattgttggcccaaccgattgtatcttatccttaggtggtttaccttctgatttcaacaccggttccttctcatatggttacaccactaagaatgtcgttgaattccattccaactactgtaaattcaaatctgcaacttatgaaaacttgatgatgaagggcgcagtccaaagattgatcagcgaattgaagaatattaagtattccaatgtctcaactttatctccaccaaaatctaaatttgcttacgaatctgcaaaggttgctccagaaggtatcatcactcaagattacctgtggaagagattatcttacttcttaaagccaagagatatcattgtcactgaaactggtacttcctcctttggtgtcttggctacccacttaccaagagattcaaagtctatctcccaagtcttatggggttccattggtttctccttaccagctgcagttggtgctgcatttgctgctgaagatgcacacaaacaaactggcgaacaagaaagaagaactgttttgtttattggtgatggttctttacaattgactgtccaatcaatctcagatgctgcaagatggaacatcaagccatacatcttcatcttaaacaacagaggttacactatcgaaaagttgatccacggtcgtcatgaggactacaaccaaattcaaccatgggatcaccaattgttattgaagctctttgctgacaagacccaatatgaaaaccatgttgttaaatccgctaaggacttggacgctttgatgaaggatgaagcattcaacaaggaagataagattagagtcattgaattattcttggatgaattcgatgctccagaaatcttggttgctcaagctaaattatctgatgaaatcaactctaaagccgcttaa

SEQ ID NO: 49 - protein, 575 aa, Issatchenkia orientalis
MTDKISLGTYLFEKLKEAGSYSIFGVPGDFNLALLDHVKEVEGIRWVGNANELNAGYEADGYARINGFASLITTFGVGELSAVNAIAGSYAEHVPLIHIVGMPSLSAMKNNLLLHHTLGDTRFDNFTEMSKKISAKVEIVYDLESAPKLINNLIETAYHTKRPVYLGLPSNFADELVPAALVKENKLHLEEPLNNPVAEEEFIHNVVEMVKKAEKPIILVDACAARHNISKEVRELAKLTKFPVFTTPMGKSTVDEDDEEFFGLYLGSLSAPDVKDIVGPTDCILSLGGLPSDFNTGSFSYGYTTKNVVEFHSNYCKFKSATYENLMMKGAVQRLISELKNIKYSNVSTLSPPKSKFAYESAKVAPEGIITQDYLWKRLSYFLKPRDIIVTETGTSSFGVLATHLPRDSKSISQVLWGSIGFSLPAAVGAAFAAEDAHKQTGEQERRTVLFIGDGSLQLTVQSISDAARWNIKPYIFILNNRGYTIEKLIHGRHEDYNQIQPWDHQLLLKLFADKTQYENHVVKSAKDLDALMKDEAFNKEDKIRVIELFLDEFDAPEILVAQAKLSDEINSKAA

SEQ ID NO: 50 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 51 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 52 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 53 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 54 - protein, 528 aa, Pseudomonas putida [sequence omitted]

SEQ ID NO: 55 - protein, 528 aa, Pseudomonas aeruginosa
MKTVHSASYEILRRHGLTTVFGNPGSNELPFLKDFPEDFRYILGLHEGAVVGMADGFALASGRPAFVNLHAAAGTGNGMGALTNAWYSHSPLVITAGQQVRSMIGVEAMLANVDAGQLPKPLVKWSHEPACAQDVPRALSQAIQTASLPPRAPVYLSIPYDDWAQPAPAGVEHLAARQVSGAALPAPALLAELGERLSRSRNPVLVLGPDVDGANANGLAVELAEKLRMPAWVAPSASRCPFPTRHACFRGVLPAAIAGISRLLDGHDLILVVGAPVFRYHQFAPGDYLPAGAELVQVTCDPGEAARAPMGDALVGDIALTLEALLEQVRPSARPLPEALPRPPALAEEGGPLRPETVFDVIDALAPRDAIFVKESTSTVTAFWQRVEMREPGSYFFPAAGGLGFGLPAAVGAQLAQPRRQVIGIIGDGSANYGITALWSAAQYRVPAVFIILKNGTYGALRWFAGVLEVPDAPGLDVPGLDFCAIARGYGVEALHAATREELEGALKHALAADRPVLIEVPTQTIEP

SEQ ID NO: 56 - protein, 526 aa, Pseudomonas stutzeri
MASVHSITYELLRRQGIDTVFGNPGSNELPFLKDFPEDFRYILALQEACVVGIADGYAQASRKPAFINLHSAAGTGNAMGAMSNAWNCHSPLIVTAGQQNRAMIGVEALLTNVDAASLPRPLVKWSYEPASAAEVPHAMSRAIHMASMAPRGPVYLSVPYDDWDKEADPQSHHLYDRSVNSAVRLNDQDLEVLVEALNSASNPAIVLGPDVDSANANADCVTLAERLKAPVWVAPSAPRCPFPTRHPCFRGLMPAGIAAISQLLEGHDVVLVIGAPVFRYHQYDPGQYLKPGTRLISITCDPLEAARAPMGDAIVADIGTMTAALASRIGESERQLPAVLPSPERVNQDAGRLRPETVFDTLNEMAPEDAIYLNESTSTTAQMWQRLNMRNPGSYYFCAAGGLGFALPAAIGVQLAEPDRQVIAVIGDGSANYSISALWTAAHYNIPAIFLIMNNGTYGALRWFAGVLEAENVPGLDVPGIDFCAIAKGYGIPALKADNLEQLKGSIHEALSAKGPVLIEVSTVSL

SEQ ID NO: 57 - protein, 528 aa, Pseudomonas fluorescens
MKTVHSASYDILRQQGLTTVFGNPGSNELPFLKGFPEDFRYILGLHEGAVVGMADGFALASGQPAFVNLHAAAGTGNGMGALTNAWYSHSPLVITAGQQVRSMIGVEAMLANVDAPQLPKPLVKWSAEPACAEDVPRALSQAIHMANQAPKGPVYLSIPYDDWARPAPAGVEHLARRQVATAGLPSAAQLRSLVQRLAAARNPVLVLGPDVDGSRSNHLAVQLAEKLRMPAWVAPSASRCPFPTRHPSFRGVLPAAIAGISRCLADHDLILVVGAPVFRYHQFAPGDYLPAGTELLHITCDPGEAARAPMGDALVGDIVETLQALVWALPDCDRPQPQALPPAAPVEELGGLLRPETVFDVIDELAPKDAIYVKESTSTVGAFWQRVEMREPGSYYFPAAGGLGFGLPAAVGVQLARPERRVIGVIGDGSANYGITALWTAAQYQIPVVFIILKNGTYGALRWFAGVLQVSDAPGLDVPGLDFCAIGRGYGVHSVQANTREAFAQALSEALAGDRPVLIEVPTLTIEP

SEQ ID NO: 58 - protein, 1220 aa, Chloroflexus aurantiacus
MATGESMSGTGRLAGKIALITGGAGNIGSELTRRFLAEGATVIISGRNRAKLTALAEMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWAGENTGGIHWILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLAMYLERYGARQVWIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 59 - protein, 1229 aa, Roseiflexus castenholzii
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRIAEINLYLPEEIVGTIGVHNPGFGWAESLFGLHMGKVALITGGSAGIGGQIGRLLALSGAHVMLAARNADQLEQMRASIVREVRDASYPDAESRVAIFPGSDVSDIDGLERLVNHTVRVFGKVDYLINNAGIAGAEEMVIDMPVDAWRHTLRANLISNYALLRRLAPQMKAAGGAYVLNVSSYFGGEKYVAIPYPNRSDYAVSKAGQRAMVESLARFLGPEIQINAIAPGPVEGERLKGAGSRPGLFMRRARLILENKRLNEVFAALLAARHEGATIADLLPDLFANDIQSIANSAAMPAPLRRLATMLRETSDAGGSAQSYLMNATIARKLLNRLENGGYITLHDRRALTVEPPEPFFTEAQIEREAIKVRDGILGMLHLQRMPTEFDVALATVFYLADRNVTGETFHPSGGLRFERTVTEGELFGKPGQQRLERLKGSVVYLIGEHLRQHLVLLARTFLDEIHVARVVLLTETTQAATDLAAELSDYEAAGRFVVIPTCGDIEGGIDRAMAEYGRPGPVISTPFRPLPDRALSARNGDWSSVLTTAEFEELVEQQITHHFRVARKAGLIEGANVTLVTPPTSARSTSEEFALANFVKTTLHALTATAGAESERTVPHVPVNQVDLTRRARSEEPRTPSEEEEELQRFVNAVLLTSAPLPTPLESRYRARIYRGNAITV

SEQ ID NO: 60 - protein, 1217 aa, Erythrobacter sp.
MSKEGNAAKGRLEGKVALITGAAGNLGNEISRAFAREGAFVVMTGRTEERISAAREQLIADTGVAPERIDTAVLDGGNPDSIRAAMAKLRKEYGRIDILINNAGSAGPKQPLHNVPLSPQEMEACGDTETVRDAMLNILGVTWNMARIVAPMMPVGGAMVNISTIFSHTRYYGRTAYVVPKAALNALSNQLASELGPRGIRVNTVFPGPIESDRIRTVFAAMDEVQSQPKDTTANYFTGRMALTRSVNGKVDGKPLPNPKDIAGTCLFLASEEAAGIAGEEVDVTHGLSANRTSASTYMTRPSMRSLDGAGLNIFIVSGENWDDALVAAHTLIGSGAKVRLGLARNADVAQANARLKAQGIGEELTVTRFNRAEPDAMEDALAAFSGDVDGAITGAIILPVKPSGHFTGSLLAADDDTVTKFMDTELVGAIAVSRSLARYWHGREDLQSPPRCVFMTNPGDPLGNSFASVLSAGITQLIRIWRDEERVQAGNGSTEHAVWSNQIVRHTNTEDENTRFASGHATRVLFREQHIAEIDLKLPANISEETGSRKAMVGFAENITGLHLGKVAFITGGSAGIGGQVARLLALAGAKVMMVARRESELVAARDRIVGELQDIGFAGVERRVKYMADIDVSDFASLDKAVDATLEEFGRIDYLINNAGVAGAEDMVIDMEPEAWRFTLDANLISNYHLMQRVVPLMKEQGSGYVLNVSSYFGGEKFLAVAYPNRADYGLSKAGQRAMVEAFSPFLGPEVQCNAIAPGPVDGDRLSGTGGKPGLFQRRAKLILENKRLNAVYSAVIHAIREGGDAAKILTRLSRNSTSTLSHDAEAPEELRKLALDFASQGDGLCTWDQYLLTDAMAQRLLVRLQLGGFLLGSNEWASLSSSEQTWLKLSPPDDKPFLPAAQVDKVANGVGKGVISQLHLGAMPTEAEVAQATVFFLADRAVSGETFMPSGGLRVERSNTEREMFGSPKQERIDKMKGKTVWIIGEHLSDYVAATIEELVSGCGVAKVVLIAKDKSGEKAVRDQLPNDLSKDALEVLIAGDGLEEAMDEALGHWGKPTTVLSMPGEPLPDHLFEGGNPLSTKDFAHMVEANITRHYRVTRKASLYDGCQVVLVSPDVPYGSDGPGVALANFVKTSLHAFTATVAVENERLVHDVPVNQINLTRRVSSEEPRDADEHAEELRRFTRAVLLVGAPLPDAQDSRYRSKIYRGTSMTV

SEQ ID NO: 61 - protein, 357 aa, Metallosphaera sedula
MRRTLKAAILGATGLVGIEYVRMLADHPYIKPTYLAGKGSVGKPYGEIVRWQTVGNVPKEVANQEVKPTDPKLMDDVDIIFSPLPQGAAGPVEEQFAKLGFNVISNSPDHRFDMDVPMIIPEVNPHTVTLIDEQRKRRDWKGFIVTTPLCTAQGAAIPLTPIYQNFKMSGVMITTMQSLSGAGYPGIASLDIVDNALPLGDGYDAKTVKEITRILSEVKRNVQEPGVNEITLDATTHRIATIHGHYEVAYVTFKEDTDVRKVMESMESFKGEPQDLKLPTAPEKPIIVTTQDARPQVFFDRWAGNPPGMSVVVGRLKQVNPRTIRFVSLIHNTVRGAAGGGVLTAELLVEKGYIDKR

SEQ ID NO: 62 - protein, 356 aa, Sulfolobus tokodaii
MRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 63 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 64 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 65 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 66 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 67 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 68 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 69 - protein, 474 aa, Escherichia coli [sequence omitted]

SEQ ID NO: 70 - protein, 371 aa, Bacillus subtilis
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 71 - protein, 325 aa, Bacillus subtilis
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 72 - protein, 442 aa, Bacillus subtilis
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 73 - protein, 470 aa, Bacillus subtilis
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 74 - protein, 2123 aa, Saccharomyces cerevisiae
MRSIRKWAYETFNDEKIIQFVVMATPDDLHANSEYIRMADQYVQVPGGTNNNNYANIDLILDVAEQTDVDAVWAGWGHASENPCLPELLASSQRKILFIGPPGRAMRSLGDKISSTIVAQSAKIPCIPWSGSHIDTIHIDNKTNFVSVPDDVYVRGCCSSPEDALEKAKLIGFPVMIKASEGGGGKGIRRVDNEDDFIALYRQAVNETPGSPMFVMKVVTDARHLEVQLLADQYGTNITLFGRDCSIQRRHQKIIEEAPVTITKPETFQRMERAAIRLGELVGYVSAGTVEYLYSPKDDKFYFLELNPRLQVEHPTTEMISGVNLPATQLQIAMGIPMHMISDIRKLYGLDPTGTSYIDFKNLKRPSPKGHCISCRITSEDPNEGFKPSTGKIHELNFRSSSNVWGYFSVGNNGAIHSFSDSQFGHIFAVGNDRQDAKQNMVLALKDFSIRGEFKTPIEYLIELLETRDFESNNISTGWLDDLILKNLSSDSKLDPTLAIICGAAMKAYVFTEKVRNKYLELLRRGQVPPKDFLKTKFPVDFIFDNNRYLFNVAQSSEEQFILSINKSQCEVNVQKLSSDCLLISVDGKCHTVYWKDDIRGTRLSIDSNTIFLEAELNPTQVISPTPGKLVKYLVRSGDHVFAGQQYAEIEIMKMQMPLVAKSDGVIELLRQPGSIIEAGDVIAKLTLDSPSKANESSLYRGELPVLGPPLIEGSRPNHKLRVLINRLENILNGYHENSGIETTLKELIKILRDGRLPYSEWDSQISTVRNRLPRQLNEGLGNLVKKSVSFPAKELHKLMKRYLEENTNDHVVYVALQPLLKISERYSEGLANHECEIFLKLIKKYYAVEKIFENHDIHEERNLLNLRRKDLTNLKKILCISLSHANVVAKNKLVTAILHEYEPLCQDSSKMSLKFRAVIHDLASLESKWAKEVAVKARSVLLRGIFPPIKKRKEHIKTLLQLHIKDTGAENIHSRNIYSCMRDFGNLIHSNLIQLQDLFFFFGHQDTALSSIASEIYARYAYGNYQLKSIKIHKGAPDLLMSWQFSSLRNYLVNSDGESDEFTKLSKPPSTSGKSSANSFGLLVNMRALESLEKTLDEVYEQIHIPEERLSSGENSLIVNILSPIRYRSENDLIKTLKIKLHENERGLSKLKVNRITFAFIAANAPAVKFYSFDGTTYDEISQIRNMDPSYEAPLELGKMSNYKIRSLPTYDSSIRIFEGISKFTPLDKRFFVRKIINSFMYNDQKTTEENLKAEINAQVVYMLEHLGAVDISNSDLNHIFLSFNTVLNIPVHRLEEIVSTILKTHETRLFQERITDVEICISVECLETKKPAPLRLLISNKSGYVVKIETYYEKIGKNGNLILEPCSEQSHYSQKSLSLPYSVKDWLQPKRYKAQFMGTTYVYDFPGLFHQAAIQQWKRYFPKHKLNDSFFSWVELIEQNGNLIKVNREPGLNNIGMVAFEIMVQTPEYPEGRNMIVISNDITYNIGSFGPREDLFFDRVTNYARERGIPRIYLAANSGAKLGIAEELIPLFRVAWNDPSDPTKGFQYLYLAPKDMQLLKDSGKGNSVVVEHKMVYGEERYIIKAIVGFEEGLGVECLQGSGLIAGATSKAYRDIFTITAVTCRSVGIGSYLVRLGQRTIQVEDKPIILTGASAINKVLGTDIYTSNLQIGGTQIMYKNGIAHLTASNDMKAIEKIMTWLSYVPAKRDMSPPLLETMDRWDRDVDFKPAKQVPYEARWLIEGKWDSNNNFQSGLFDKDSFFETLSGWAKGVIVGRARLGGIPVGVIAVETKTIEEIIPADPANLDSSEFSVKEAGQVWYPNSAFKTAQTINDFNYGEQLPLIILANWRGFSGGQRDMYNEVLKYGSFIVDALVDYKQPILIYIPPFGELRGGSWVVIDPTINPEQMEMYADVESRGGVLEPDGVVSIKYRKEKMIETMIRLDSTYGHLRRTLTEKKLSLEKQNDLTKRLKIRERQLIPIYNQISIQFADLHDRSTRMLVKGVIRNELEWKKSRRFLYWRLRRRLNEGQVIKRLQKKTCDNKTKMKYDDLLKIVQSWYNDLDVNDDRAVVEFIERNSKKIDKNIEEFEISLLIDELKKKFEDRRGNIVLEELTRLVDSKRKR

SEQ ID NO: 75 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLADLADLDVLSTEDLKNRRYQRLMSYGYA

SEQ ID NO: 76 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 77 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 78 - protein, 304 aa, Escherichia coli
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 79 - protein, 282 aa, Chloroflexus aurantiacus
MEETAIPQSLTPWDRVQLARHPQRPHTLDYIAALCEDFVELHGDRRFGDDPAMVGGMATFAGQTVMVIGHQKGNDTRENMRRNFGMPHPEGYRKAQRLMRHAEKFGLPVICFVDTPAADPTKSSEERGQANAIAESIMLMTTLRVPSIAVVIGEGGSGGALAISVADRILMQENAIYSVAPPEAAASILWRDAAKAPEAARALKLTAADLYDLRIIDEVIPEPPGGAHADRLTAITTVGERLRVHLADLQQRDIDTLLRERYRKYRSMGQYQEQQMDFFGRM

SEQ ID NO: 80 - protein, 180 aa, Chloroflexus aurantiacus
MMLWGAMKDETTELPADQPDPFGLAAVRVLLQMLEQSDVYEITIENGNAKLHVKRGQPGGVIYSAPLPTAPVPSPSLPATPVTPFVQPPPAPEGPPVEMPAGHTITAPMVGTFYAAPSPRDRPFVQEGDEVRVGDTVGIVEAMKMMNEIESDVAGRVARILVKNGQPVEYGQPLMVIEPL

SEQ ID NO: 81 - protein, 455 aa, Chloroflexus aurantiacus
MIRKVLVANRGEIAVRIIRACQELGIRTVVAYSTADRDSLAVRLADEAVCIGPPPAAKSYLNAPALISAALVSGCDAIHPGYGFLSENPYFAEMCADCKLTFIGPPPEPIRLMGDKAIGRETMRKAGVPTVPGSDGEVRSLEEAIDVARQIGYPVLLKPSGGGGGRGMRVAYDEADLQRAFPTARAEAEAAFGNGALLLEKYLTRVRHVEIQVLADQYGHAIHLGERDCSAQRRHQKIVEEAPSPAVTPELRERMGADAVRGIKSIGYVNAGTLEFLLDQDGNYYFIEMNTRIQVEHPVTEQVTGIDLVRWQLLIASGERLTLRQEDIKITRHAIECRINAEDPERDFLPASGEVEFYLPPGGPGVRVDSHLYSGYTPPGTYDSLLAKIITFGDTRDEALNRMRRALNECVITGIKTTIPFQLALIDDPEFRAGRIHTGYVAELLRQWKETLNPV

SEQ ID NO: 82 - protein, 305 aa, Chloroflexus aurantiacus
MKEFFRLSRKGFTGREDQDSAQIPDDLWVKCSSCRELIYKKQLNDNLKVCPKCGHHMRLSAHEWLGLLDVGSFREMDANLLPTDPLGFVTDEESYAAKLAKTQQRTGMADAVIAGIGAISNMQICVAVADFSFMGASMGSVYGEKMARSAERAAELGVPLLTINTSGGARQQEGVIGLMQMAKVTMALTRLADAGQPHIALLVDPCYGGVTASYPSVADIIIAEPGANIGFAGKRLIEQIMRQKLPAGFQTAEFMLEHGMIDMVVPRSEMRDTLARILRLYRQRSTSPAKAELAGRRATLPQPIM

SEQ ID NO: 83 - protein, 378 aa, Bacillus subtilis
MIIGVPKEIKNNENRVALTPGGVSQLISNGHRVLVETGAGLGSGFENEAYESAGAEIIADPKQVWDAEMVMKVKEPLPEEYVYFRKGLVLFTYLHLAAEPELAQALKDKGVTAIAYETVSEGRTLPLLTPMSEVAGRMAAQIGAQFLEKPKGGKGILLAGVPGVSRGKVTIIGGGVVGTNAAKMAVGLGADVTIIDLNADRLRQLDDIFGHQIKTLISNPVNIADAVAEADLLICAVLIPGAKAPTLVTEEMVKQMKPGSVIVDVAIDQGGIVETVDHITTHDQPTYEKHGVVHYAVANMPGAVPRTSTIALTNVTVPYALQIANKGAVKALADNTALRAGLNTANGHVTYEAVARDLGYEYVPAEKALQDESSVAGA

SEQ ID NO: 84 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 85 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 86 - protein, 471 aa, Bacillus subtilis
MKNKWYKPKRHWKEIELWKDVPEEKWNDWLWQLTHTVRTLDDLKKVINLTEDEEEGVRISTKTIPLNITPYYASLMDPDNPRCPVRMQSVPLSEEMHKTKYDLEDPLHEDEDSPVPGLTHRYPDRVLFLVTNQCSMYCRYCTRRRFSGQIGMGVPKKQLDAAIAYIRETPEIRDCLISGGDGLLINDQILEYILKELRSIPHLEVIRIGTRAPVVFPQRITDHLCEILKKYHPVWLNTHFNTSIEMTEESVEACEKLVNAGVPVGNQAVVLAGINDSVPIMKKLMHDLVKIRVRPYYIYQCDLSEGIGHFRAPVSKGLEIIEGLRGHTSGYAVPTFVVDAPGGGGKIALQPNYVLSQSPDKVILRNFEGVITSYPEPENYIPNQADAYFESVFPETADKKEPIGLSAIFADKEVSFTPENVDRIKRREAYIANPEHETLKDRREKRDQLKEKKFLAQQKKQKETECGGDSS

SEQ ID NO: 87 - protein, 416 aa, Porphyromonas gingivalis
MAESRRKYYFPDVTDEQWNDWHWQVLNRIETLDQLKKYVTLTAEEEEGVKESLKVLRMAITPYYLSLIDPENPNCPIRKQAIPTHQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVDAPGGGGKIPVMPNYVVSQSPRHVVLRNYEGVITTYTEPENYHEECDCEDCRAGKHKEGVAALSGGQQLAIEPSDLARKKRKFDKN

SEQ ID NO: 88 - protein, 425 aa, Fusobacterium nucleatum
MNTVNTRKKFFPNVTDEEWNDWTWQVKNRIEKIDDLKKYVELSAEEEEGVVRTLETLRMAITPYYFSLIDMNSDRCPIRKQAIPTIQEIHQSDADLLDPLHEDEDSPVPGLTHRYPDRVLLLITDMCSMYCRHCTRRRFAGSSDDAMPMDRIDKAIEYIAKTPQVRDVLLSGGDALLVSDKKLESIIQKLRAIPHVEIIRIGSRTPVVLPQRITPELCNMLKKYHPIWLNTHFNHPQEVTPEAKKACEMLADAGVPLGNQTVLLRGINDSVPVMKRLVHDLVMMRVRPYYIYQCDLSMGLEHFRTPVSKGIEIIEGLRGHTSGYAVPTFVVDAPGGGGKTPVMPQYVISQSPHRVVLRNFEGVITTYTEPENYTHEPCYDEEKFEKMYEISGVYMLDEGLKMSLEPSHLARHERNKKRAEAEGKK

SEQ ID NO: 89 - protein, 517 aa, Megasphaera elsdenii
MRKVEIITAEQAAQLVKDNDTITSIGFVSSAHPEALTKALEKRFLDTNTPQNLTYIYAGSQGKRDGRAAEHLAHTGLLKRAIIGHWQTVPAIGKLAVENKIEAYNFSQGTLVHWFRALAGHKLGVFTDIGLETFLDPRQLGGKLNDVTKEDLVKLIEVDGHEQLFYPTFPVNVAFLRGTYADESGNITMDEEIGPFESTSVAQAVHNCGGKVVVQVKDVVAHGSLDPRMVKIPGIYVDYVVVAAPEDHQQTYDCEYDPSLSGEHRAPEGATDAALPMSAKKIIGRRGALELTENAVVNLGVGAPEYVASVAGEEGIADTITLTVEGGAIGGVPQGGARFGSSRNADAIIDHTYQFDFYDGGGLDIAYLGLAQCDGSGNINVSKFGTNVAGCGGFPNISQQTPNVYFCGTFTAGGLKIAVEDGKVKILQEGKAKKFIKAVDQITFNGSYAARNGKHVLYITERCVFELTKEGLKLIEVAPGIDIEKDILAHMDFKPIIDNPKLMDARLFQDGPMGLKK

SEQ ID NO: 90 - protein, 145 aa, Clostridium propionicum
MVGKKVVHHLMMSAKDAHYTGNLVNGARIVNQWGDVGTELMVYVDGDISLFLGYKDIEFTAPVYVGDFMEYHGWIEKVGNQSYTCKFEAWKVATMVDITNPQDTRATACEPPVLCGRATGSLFIAKKDQRGPQESSFKERKHPGE

SEQ ID NO: 91 - protein, 260 aa, Phytophthora sojae
MAAEYESILTEVRGKVAIITLNRPKALNALCSPLIEELNGAAHAFDADPSIGAIVITGSGSKAFAAGADIKEMATKTFVDAYKSNMFANWGDITKVSKPVIAAVNGYALGGGCELAMLCDLIIAGDSAKFGQPEITLGTIPGCGGTQRLIRAVGKSKAMEMILTGNMIDAQQAERDGLVARVVPADQLLDEALKTANKIASFSQPVVKMAKEAVNAAYEQSLQEGLKYESRLFWSSFATKDQKEGMAAFVEKRKADFKDE

SEQ ID NO: 92 - protein, 258 aa, Chloroflexus aurantiacus
MSEESLVLSTIEGPIAILTLNRPQALNALSPALIDDLIRHLEACDADDTIRVIIITGAGRAFAAGADIKAMANATPIDMLTSGMIARWARIAAVRKPVIAAVNGYALGGGCELAMMCDIIIASENAQFGQPEINLGIIPGAGGTQRLTRALGPYRAMELILTGATISAQEALAHGLVCRVCPPESLLDEARRIAQTIATKSPLAVQLAKEAVRMAAETTVREGLAIELRNFYLLFASADQKEGMQAFIEKRAPNFSGR

SEQ ID NO: 93 - protein, 288 aa, Rhodospirillum rubrum
MAAAPGPPAARPRAARQSRMILPPLREQAQMAYENILVETNGKVGIVTLNRPKALNALSAGLVRDLGAALDAFEADVNVHVIVLTGSDKAFAAGADIKEMAEKSYMDAYLEDFITKGWERVTTCRKPIIAAVAGFALGGGCEMAMMCDFIIAAQNAKFGQPEINLGTLPGAGGTQRLTRFVGKSKAMDMCLTGRMMDADEAWKCGLVSRIVPVDDLKDEVLKIAEAIADKSLPITMMVKEAVNAAYETTLAQGVRFERRLFQASFATDDQKEGMNAFIEKRQPSFTDR

SEQ ID NO: 94 - protein, 258 aa, Rhodobacter capsulatus
MSYQTLIVEIADGVALIRLNRPEALNALNSQLLGELAAALSTLDADPAVRCFVLTGSDKAFAAGADIKEMADKSFVDMLKLDFFGTEGDAILRTRKPVIAAVAGYALGGGCELAMMCDFILCAENAKFGQPEINLGVVAGIGGTQRLTRFVGKSKSMEMHLTGRFMDAAEAERSGLVSRVLPLADLLPEALATARKIAEKSAIATMVAKDCVNRAYETTLREGVLYERRVFHALFATEDQKEGMAAFAEKRPAKFADK

SEQ ID NO: 95 - protein, 290 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 96 - protein, 399 aa, Pseudomonas fluorescens
MRVVLCKFALLRSHDGSSANILIKNNKSRELSMTAQVSTEASHAAILQDEVLAEVRNHIGHLTLNRPAGLNALTLQMVRSLTSQLQAWSDDPQVYAVVLRGAGEKAFCAGGDIRSLYDSFKNGDTLHQDFFVEEYALDLAIHHYRKPVLALMDGFVLGGGMGLVQGADLRVVTERSRLAMPEVAIGYFPDVGGSYFLPRIPGELGIYLGVTGVQIRAADALYCGLADWYLDSHKLADLDQKLDNLRWHDSPLKDLQGALARLAVQQLPDAPLAALRPAIDHFFALPDVPSIVEQLQQVTVADSHEWALNTVSLMQTRSPLAMAVTLEMLRRGRRLSLEQCFALELHLDRQWFERGDLIEGVRALIIDKDKSPRWNPPTLHGLALNHVESFFHHFEKVVK

SEQ ID NO: 97 - protein, 351 aa, Bacillus cereus
MTEQVLFSVSENGVATITLNRPKALNSLSYDMLQPIGQKLKEWEHDERIALIVLKGAGTKGFCAGGDIKTLYEARSNEVALQHAERFFEEEYEIDTYIYQYTKPIIACLDGIVMGGGVGLTNGAKYRIVTERTKWAMPEMNIGFFPDVGAAYFLNKAPGYTGRFVALTASILKASDVLFINAADYFMTSDSLPEFLTELESVNWHKEDDVHTNLKEVIRTFATAPNLESELAPSLEVINSHFAFDTIEEIIHSLEKDESSFALKTKEILLSKSPISLKVTLKQFIDGQDKSVEECFATDLILAKNFMRHEDFFEGVRSVVVDKDQNPNYKYKQLSDVSEEDVNRFFNLLNA

SEQ ID NO: 98 - protein, 381 aa, Homo sapiens
MWRLMSRFNAFKRTNTILHHLRMSKHTDAAEEVLLEKKGCAGVITLNRPKFLNALTLNMIRQIYPQLKKWEQDPETFVIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFFATTPRKTWLLPCINGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 99 - protein, 261 aa, Megasphaera elsdenii
VKTVYTLGIDVGSSSSKAVILEDGKKIVAHAVVEIGTGSTGPERVLDEVFKDTNLKIEDMANIIATGYGRFNVDCAKGEVSEITCHAKGALFECPGTTTILDIGGQDVKSIKLNGQGLVMQFAMNDKCAAGTGRFLDVMSKVLEIPMSEMGDWYFKSKHPAAVSSTCTVFAESEVISLLSKNVPKEDIVAGVHQSIAAKACALVRRVGVGEDLTMTGGGSRDPGVVDAVSKELGIPVRVALHPQAVGALGAALIAYDKIKK

SEQ ID NO: 100 - protein, 428 aa, Megasphaera elsdenii
MSEEKTVDIESMSSKEALGYFLPKVDEDARKAKKEGRLVCWSASVAPPEFCTAMDIAIVYPETHAAGIGARHGAPAMLEVAENKGYNQDICSYCRVNMGYMELLKQQALTGETPEVLKNSPASPIPLPDVVLTCNNICNTLLKWYENLAKELNVPLINIDVPFNHEFPVTKHAKQYIVGEFKHAIKQLEDLCGRPFDYDKFFEVQKQTQRSIAAWNKIATYFQYKPSPLNGFDLFNYMGLAVAARSLNYSEITFNKFLKELDEKVANKKWAFGENEKSRVTWEGIAVWIALGHTFKELKGQGALMTGSAYPGMWDVSYEPGDLESMAEAYSRTYINCCLEQRGAVLEKVVRDGKCDGLIMHQNRSCKNMSLLNNEGGQRIQKNLGVPYVIFDGDQTDARNFSEAQFDTRVEALAEMMADKKANEGGNH

SEQ ID NO: 101 - protein, 372 aa, Megasphaera elsdenii
MSQIDELISKLQEVSNHPQKTVLNYKKQGKGLVGMMPYYAPEEIVYAAGYLPVGMFGSQNPQISAARTYLPPFACSLMQADMELQLNGTYDCLDAVIFSVPCDTLRCMSQKWHGKAPVIVFTQPQNRKIRPAVDFLKAEYEHVRTELGRILNVKISDLAIQEAIKVYNENRQVMREFCDVAAQYPQIFTPIKRHDVIKARWFMDKAEHTALVRELIDAVKKEPVQPWNGKKVILSGIMAEPDEFLDIFSEFNIAVVADDLAQESRQFRTDVPSGIDPLEQLAQQWQDFDGCPLALNEDKPRGQMLIDMTKKYNADAVVICMMRFCDPEEFDYPIYKPEFEAAGVRYTVLDLDIESPSLEQLRTRIQAFSEIL

SEQ ID NO: 102 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 103 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 104 - protein, 495 aa, Klebsiella pneumoniae
MNFQHLAYWQEKAKNLAIETRLFINGEYCAAADNTTFETIDPAAQQTLAQVARGKKADVERAVKAARQAFDNGDWSQASPAQRKAILTRFADLMEAHREELALLETLDTGKPIRHSLRDDIPGAARAIRWYAEALDKVYGEVAPTGSNELAMIVREPIGVIAAVVPWNFPLLLACWKLGPALAAGNSVILKPSEKSPLTALRLAGLAKEAGLPDGVLNVVSGFGHEAGQALALHPDVEVITFTGSTRTGKQLLKDAGDSNMKRVWLEAGGKSANIVFADCPDLQQAVRATAGGIFYNQGQVCIAGTRLLLEESIADEFLARLKAEAQHWQPGNPLDPDTTMGMLIDNTHADNVHSFIRGGESQSTLFLDGRKNPWPAAVGPTIFVDVDPASTLSREEIFGPVLVVTRFKSEEEALKLANDSDYGLGAAVWTRDLSRAHRMSRRLKAGSVFVNNYNDGDMTVPFGGYKQSGNGRDKSLHALEKFTELKTIWIALES

SEQ ID NO: 105 - DNA, 1053 bp, Issatchenkia orientalis
atgtcttacgaaatcccacaaacacaaaaggcctgtgtcttttacgaaaacggcggcccaatcacatacaaggacattccagttccaaagccaaaacctactgagattttagtcaaggttctgtactctggtgtctgccacaccgacttgcacgcatggaagggtgactggcctctagctaccaagttgccattggttggtggtcacgaaggtgccggtgttgttgttgccaagggtgaaaacgtcacctcttttgagattggtgattacgcaggtatcaagtggttgaatggttcatgtatgggttgtgaattctgtgaacaaggtgctgaaccaaactgtcctaaggccgacttgagtggttacacccacgacggttccttccaacagtatgctactgctgacgctattcaagctgcacacatctccaaggaaaccgacttggctggtgttgctccaatcttgtgtgcaggtgtcactgtctacaaggctttaaagactgcagaccttagagcaggtgaatgggtttgtatttccggtgcagctggtggtttaggttctcttgctattcaatatgcaaaggctatgggtctgagagttgttggtattgacggtggtgacgaaaagaaggaattgtgtaaatcccttggtgctgaagcatttattgatttcacaaagaccaaggatatcgtcaaggctgtccaagaggcaaccaatggtggtccacatggtgtcatcaatgtctctgtctctgaagctgcaatttctcaatcttgtgaatacgttagacctctaggtaaggttgttcttgttggtttaccagcaggcgcacaagtcaaaactggtgtctttgaagccgttgtcaagtctattgaaattaagggttcttatgtcggtaacagaaaggataccgccgaagcacttgacttctacactagaggcttggtcaagtctccattcaagattgtcggtttatccgaattgccaaaagtctttgaactcatggaacagggtaagattttaggtagaatggtcttagacacctccaaataa

SEQ ID NO: 106 - protein, 350 aa, Issatchenkia orientalis
MSYEIPQTQKACVFYENGGPITYKDIPVPKPKPTEILVKVLYSGVCHTDLHAWKGDWPLATKLPLVGGHEGAGVVVAKGENVTSFEIGDYAGIKWLNGSCMGCEFCEQGAEPNCPKADLSGYTHDGSFQQYATADAIQAAHISKETDLAGVAPILCAGVTVYKALKTADLRAGEWVCISGAAGGLGSLAIQYAKAMGLRVVGIDGGDEKKELCKSLGAEAFIDFTKTKDIVKAVQEATNGGPHGVINVSVSEAAISQSCEYVRPLGKVVLVGLPAGAQVKTGVFEAVVKSIEIKGSYVGNRKDTAEALDFYTRGLVKSPFKIVGLSELPKVFELMEQGKILGRMVLDTSK

SEQ ID NO: 107 - DNA, 1131 bp, Issatchenkia orientalis
atgtttgcatcaaccttcagaagtcaagctgtaagagctgcaagatttactagattccaatccacttttgccattcctgagaagcaaatgggtgttatctttgaaactcatggtggtcctttacaatacaaggaaattccagttccaaaaccaaaaccaactgaaattttaatcaatgttaaatactctggtgtctgccataccgatttacacgcatggaaaggtgactggccattaccagcaaagttacccctagttggtggtcacgaaggtgcgggcattgttgttgcgaaaggttctgcagttaccaactttgagattggcgattatgctggtattaagtggttaaacggttcatgtatgtcatgtgaattctgtgaacaaggtgatgaatctaactgtgaacatgccgatttgagtggttatactcatgatggttctttccaacaatatgccactgctgacgctattcaagctgcaaagatcccaaagggtaccgacttatctgaagttgcgccaattttatgtgctggtgttactgtctataaagctttgaaaactgctgatttaagagcaggtcaatgggttgcgatttctggtgccgctggtggtctaggttctcttgctgtccaatatgcaaaggcaatgggtctaagagttttaggtatcgatggtggtgaaggtaaaaaggaactttttgaacaatgtggtggtgatgtgtttatcgatttcaccagatacccaagagatgcacctgaaaagatggttgctgatattaaggctgcaactaacggtttgggtccacacggtgttatcaatgtctctgtctccccagctgctatctctcaatcatgtgactatgttagagcaactggtaaggttgtccttgtcggtatgccatctggtgctgtctgtaagtctgatgtcttcactcatgttgttaaatccttacaaattaaaggttcttatgttggtaacagagcagataccagagaagctttggaattctttaatgaaggtaaggtcagatctccaatcaaggttgtcccattatctactttacctgaaatttacgaattgatggagcaaggtaagattttaggtagatacgttgttgatacttctaaataa

SEQ ID NO: 108 - protein, 376 aa, Issatchenkia orientalis
MFASTFRSQAVRAARFTRFQSTFAIPEKQMGVIFETHGGPLQYKEIPVPKPKPTEILINVKYSGVCHTDLHAWKGDWPLPAKLPLVGGHEGAGIVVAKGSAVTNFEIGDYAGIKWLNGSCMSCEFCEQGDESNCEHADLSGYTHDGSFQQYATADAIQAAKIPKGTDLSEVAPILCAGVTVYKALKTADLRAGQWVAISGAAGGLGSLAVQYAKAMGLRVLGIDGGEGKKELFEQCGGDVFIDFTRYPRDAPEKMVADIKAATNGLGPHGVINVSVSPAAISQSCDYVRATGKVVLVGMPSGAVCKSDVFTHVVKSLQIKGSYVGNRADTREALEFFNEGKVRSPIKVVPLSTLPEIYELMEQGKILGRYVVDTSK

SEQ ID NO: 109 - DNA, 1134 bp, Issatchenkia orientalis
atgttatccaagaccatcactgctgcattgaggggcaatacaactcgtactgcattcagaatcaatgccattagaagtttagcgatcccagctattccagagacacaaaagggtgttatcttttatgagaacggaggtgaactattttacaaggacattccagttccaaagccaaagccaaatgagattttggtgaatgtcaagtattctggtgtttgtcataccgatttacacgcatggaaaggtgactggcctttggcgaccaagttgccattggttggtggacatgaaggtgccggagttgttgttgctaagggggacaatgtcaccaactttgaaattggcgattatgccggtatcaagtggttgaatggttcatgtatggggtgtgaattttgccaacaaggtgcagagccaaactgtccacaggccgacttgagtggttacacccatgacgggtcctttcaacaatatgccactgccgatgctgttcaggcagccaagattcctcagggcactgatttggctcaagttgcgccaattttatgtgcaggtattactgtctataaggctttaaagactgcagaattaagaccaggtcaatgggttgccatttctggtgctgctggaggtttaggttctcttgctgttcaatatgccaaggccatgggtttgagagttttgggtattgatggtggtgaggagaagggcaagtttgcaaagtctcttggagctgaagttttcattgatttcaccaaatccaaggacattgtcaaggatatccaagaggccaccaatggtggtccacatggtgtcattaatgtttctgtttctccagctgctatttctcaaagtacccagtatgtcagaaccttgggtaaggttgtccttgttggattaccagcgcatgctgtatgcgagtcttcggttttcgaccatgttgtcaagtcgattcaaattagaggctcttatgttggtaacagggaagatactagtgaggctattgattttttcaccaggggtttagtgaagtcaccaattaagattgttggtttgagtgagttgccaaagatctatgaattgatggagcaaggtaagattttaggcagatatgttgttgacacttcgaaatga

SEQ ID NO: 110 - protein, 377 aa, Issatchenkia orientalis
MLSKTITAALRGNTTRTAFRINAIRSLAIPAIPETQKGVIFYENGGELFYKDIPVPKPKPNEILVNVKYSGVCHTDLHAWKGDWPLATKLPLVGGHEGAGVVVAKGDNVTNFEIGDYAGIKWLNGSCMGCEFCQQGAEPNCPQADLSGYTHDGSFQQYATADAVQAAKIPQGTDLAQVAPILCAGITVYKALKTAELRPGQWVAISGAAGGLGSLAVQYAKAMGLRVLGIDGGEEKGKFAKSLGAEVFIDFTKSKDIVKDIQEATNGGPHGVINVSVSPAAISQSTQYVRTLGKVVLVGLPAHAVCESSVFDHVVKSIQIRGSYVGNREDTSEAIDFFTRGLVKSPIKIVGLSELPKIYELMEQGKILGRYVVDTSK

SEQ ID NO: 111 - DNA, 1347 bp, Issatchenkia orientalis
atgtctccttcacaaattaacgttgacaacttatctaattggactgaagaattcaaatctgacgccaagactcaaatcgggggttctgtattgcaacattccaacattgatgaggtcttgattaacagagatgcagaaatcgccaacaagcatatcttcaaccacaagattgaaattgaaggtctacctgtcatggatcagaaggcttctggtagatgttggttgtttgcatcgactaacttgatgcgtgttactgcaatgaagaaatacaatttgaaggaaatcaagctttccccatcgtatttgtttttctatgacaaattggaaagagcaaactatttccttgaacaaatcatcgacactcataaggaaccaatcgattcaagattggttcaatatttcctgaccaatccagttgaagatggtggtcaattcaccatgatggcacaaattgctaccaaatacggtgttgttcctgatcaagtctacccagattctttcaacacaaccacttcgaggattatgaacagattagtcaaccacagattacgttcttatgcaatgactttacgtaacgctctagatgaaggtaaagatgtaatgtccttgaagaatgagatgcaaaaagaaatttatcgtttgctaacaatgttccttggtaacccaccaaagccaaacgaagagtttgtctgggaattcaccgataaagatggtaaatatgaatctattaaaactacaccattaaaatatgcaactgaagttttggatttccatgctccagaatatgtttccttgttaaatgacccaagaaataagtataacaagatggttcaagttgaaagattaggtaatgttgctggtggcgaaccagttgcatacttaaacttagaaattgaaaagttatctcaagctgttgttaacagaatcaaaaataacaaaccagttttctttggtaccgatacacctaaatttatggataaaagtagaggtattatggatatcaatttatgggactatgagttattaggttatgatgtccgtaccatgtcaaagaaggaaagagttgtttttggtgattctttaatgacccacgctatgttgattactgcagtgcacgttgatgaaaatggcaaacctgtcagatacagagtcgaaaacagttggggtaccaagagtggtcaagaaggttattacacaatgacccaagaatattttgaagagtacgtttatcaagtagtcattgaaaagagtgaatttgctgccctaaacctcgatgtttccattctggaggataaagaaccagtcgtcttgccaccttatgaccctatgggtgcacttgctttataa

SEQ ID NO: 112 - protein, 448 aa, Issatchenkia orientalis
MSPSQINVDNLSNWTEEFKSDAKTQIGGSVLQHSNIDEVLINRDAEIANKHIFNHKIEIEGLPVMDQKASGRCWLFASTNLMRVTAMKKYNLKEIKLSPSYLFFYDKLERANYFLEQIIDTHKEPIDSRLVQYFLTNPVEDGGQFTMMAQIATKYGVVPDQVYPDSFNTTTSRIMNRLVNHRLRSYAMTLRNALDEGKDVMSLKNEMQKEIYRLLTMFLGNPPKPNEEFVWEFTDKDGKYESIKTTPLKYATEVLDFHAPEYVSLLNDPRNKYNKMVQVERLGNVAGGEPVAYLNLEIEKLSQAVVNRIKNNKPVFFGTDTPKFMDKSRGIMDINLWDYELLGYDVRTMSKKERVVFGDSLMTHAMLITAVHVDENGKPVRYRVENSWGTKSGQEGYYTMTQEYFEEYVYQVVIEKSEFAALNLDVSILEDKEPVVLPPYDPMGALAL

SEQ ID NO: 113 - DNA, 1737 bp, Issatchenkia orientalis
atgttactcagatcactaaactcttctgctcgttgtgtcaaacaaacaaccagaacaaaggttaggtatctcagccacgtcagtggtgcaagcatggcgaaacctacattgaagaacaactcgagagaatccaacaaatccagaaactatctaattgctgctgtgacagcattggctgtatcaacctcaattggagttgccgtacatgtgaaggaccccttgtataacgatgctaccggcagtgattctccgagaagtatatctgttgacgagtttgtcaagcataattcacaaaacgactgttggattgcaatcaatggcaaggtttatgatttcactgattttattccaaaccatccaggtggggtacctccattagttaatcatgctggttatgatggtactaaactttatgagaaattgcatccaaaaggtacaattgagaaattcttgccaaaggataagtttctgggtgtgttagatggtgaagcgccaaaattggaagcagactatttggtggacgatgatgaacaagagagactggattatttgaacaacttacctcctttgtcatctattcagaatgtttatgatttcgaatacttggccaagaagattttacctaaagatgcctgggcatattattcttgtggtgccgatgatgaaatcacaatgagagaaaaccattatgcttatcaaagagtttatttcagaccaagaatttgtgttgatgtcaaggaagttgatacttcttatgaaatgttaggcactaaaacctctgttcctttttatgtatctgccaccgctttggctaaattaggccatcctgatggtgaatgctcaattgctagaggcgctggtaaggaaggtgtcgttcaaatgatttcgaccctttcctcaatgtcattagatgaaattgccgctgctagaattccaggtgcaacccaatggttccaattatacattaatgaggatagaaatgtcgctaaaggtctggtcaaacatgcagaagacttgggtatgaaggctatctttataactgttgatgctccttctctaggtaacagagaaaaggataaaagattaaagtttgttaatgacaccgatgtcgatttgggtgattccgcagatcgaaacagtggtgcttcaaaggcactatcttcgttcattgatgcttctgtctcttggaatgacgtcaaagcggtcaagtcgtggactaaattgcctgtcttagttaaaggtgttcaaacagttgaagacgttattgaagcttacgatgctggttgtcaaggtgttgttttgtcaaaccacggtggtaggcaactagatactgctcctcctccaatcgaattattagctgaaactgttccaactttgaagagattgggtaaattaagaccagattttgaaattttaattgacggtggtgtcaaaagaggtaccgatattttgaaagcagtcgcaatcggtggccaagatgtcagagtttcagttggtatgggtagacctttcttatatgccaactcttgctatggtgaagcaggtgttagaaaattaattcaaaatctaaaggatgaattagaaatggatatgagattgttgggtgtcactaaaatggaccagctatcttcgaaacatgtcgatactaaacgtttgattggtagagatgcgatcaactatttgtatgataatgtatacagcccaatcgaaaccgttaaattcaacaatgaagattga

SEQ ID NO: 114 - protein, 578 aa, Issatchenkia orientalis
MLLRSLNSSARCVKQTTRTKVRYLSHVSGASMAKPTLKNNSRESNKSRNYLIAAVTALAVSTSIGVAVHVKDPLYNDATGSDSPRSISVDEFVKHNSQNDCWIAINGKVYDFTDFIPNHPGGVPPLVNHAGYDGTKLYEKLHPKGTIEKFLPKDKFLGVLDGEAPKLEADYLVDDDEQERLDYLNNLPPLSSIQNVYDFEYLAKKILPKDAWAYYSCGADDEITMRENHYAYQRVYFRPRICVDVKEVDTSYEMLGTKTSVPFYVSATALAKLGHPDGECSIARGAGKEGVVQMISTLSSMSLDEIAAARIPGATQWFQLYINEDRNVAKGLVKHAEDLGMKAIFITVDAPSLGNREKDKRLKFVNDTDVDLGDSADRNSGASKALSSFIDASVSWNDVKAVKSWTKLPVLVKGVQTVEDVIEAYDAGCQGVVLSNHGGRQLDTAPPPIELLAETVPTLKRLGKLRPDFEILIDGGVKRGTDILKAVAIGGQDVRVSVGMGRPFLYANSCYGEAGVRKLIQNLKDELEMDMRLLGVTKMDQLSSKHVDTKRLIGRDAINYLYDNVYSPIETVKFNNED

SEQ ID NO: 115 - DNA, 1698 bp, Issatchenkia orientalis
  misc_feature (941)..(941): N= A, C, T, or G
  misc_feature (943)..(943): N= A, C, T, or G
atgttaagatcccagttcaaaaacattttgaaaaatgttaacaagaaccattctctaaggagaacttttacttccagcacctcaaaggctggaaaaaatgcttcatacaatgccaagattatatctgcaaccgtggcctcgattgttgcagcagctggctcttatatgttggtccagccttcactagctaatgatgaggcacagtctgctaatccaactaggaagatctctgttgacgaatttgttaaacacaaccatgccgatgattgttggatcactgttaacggtaacgtctatgacttgactgatttcatttcaatgcatccaggtggtactaccccattgattcaaaatgcaggtcacgacgcaactgaaatttacaacaagattcatccaaagggtacaatcgagaacttcttaccaaaggaaaagcaattgggtgttttggatggtgaagctcctaaaatcgaagttgtgcttgacgaaaaggagaaacacagattggagttgttgaatcatctccctgctctttccagaattcaaaacatttatgatttcgaacatattgcttctagagttttgagcgaccaagcatggaactactattcatgtggtgccgaagatgaaatcaccttgagggaaaatcattatgcttaccaaagaatctactttaagccaaaatgttgtgtcaatgttgcagaagttgatacctctcatgaaattttaggtacaaaagcttctgttcctttctacgtttccgcagccgcttctgcaaagttggggcacgaggatggtgaatgttccattgctagaggtgcaggtaaggaaggcgttattcaaatgatttcttccttctcttccaactctttggaggaaattgcagaatccagaattcctggtgcaacacaatggtttcaattatacgttaatgaagacaaggntnttgtgaagaagactttaaaaagggccgaaaacttgggtatgaaggccatctttgtcactgtggacgctgctagtagaggtaatagagaaaaagacattacaatgagaattaccgaagatacagatgagttaatagacgattcttctgttagagctggttctacctctggtgcattgccagctttcattgacaagaggctgacttgggatgaagttaaggatatcatttcatggaccaagttaccagttttgctgaagggtgttcaaagaactgatgatattgagaaggcaattgatattggttgtaagggtgttgtcttgtccaatcatggtggtagacaattagatacttctcctcctccaatagaagttatggctgaatctgttccaatcctaaagcaaaagggtaaactggatccaaatttcagtattttcgttgatggtggtgttagaagaggtacagatattttgaaagctttggctattggtggcagagactgtaaagttgctgttggtctgggtagacctttcctttatgcaaatactggttatggtgaaaagggtgtcagaaaggccgtgcaaattctaagagaagaattaaaggctgacatgagaatgttgggcgttacctctttgaacgagctagacgactcttacattgacaccagaagattactaggtagagatgctgttaaccacatatacaacaacaactactacccaatgtctaagattcaattcaaaaacgaaaaataa

SEQ ID NO: 116 - protein, 565 aa, Issatchenkia orientalis
  MISC_FEATURE (314)..(314): Xaa = Asp, Gly, Ala, or Val
  MISC_FEATURE (315)..(315): Xaa = Ile, Val, Leu, or Phe
MLRSQFKNILKNVNKNHSLRRTFTSSTSKAGKNASYNAKIISATVASIVAAAGSYMLVQPSLANDEAQSANPTRKISVDEFVKHNHADDCWITVNGNVYDLTDFISMHPGGTTPLIQNAGHDATEIYNKIHPKGTIENFLPKEKQLGVLDGEAPKIEVVLDEKEKHRLELLNHLPALSRIQNIYDFEHIASRVLSDQAWNYYSCGAEDEITLRENHYAYQRIYFKPKCCVNVAEVDTSHEILGTKASVPFYVSAAASAKLGHEDGECSIARGAGKEGVIQMISSFSSNSLEEIAESRIPGATQWFQLYVNEDKXXVKKTLKRAENLGMKAIFVTVDAASRGNREKDITMRITEDTDELIDDSSVRAGSTSGALPAFIDKRLTWDEVKDIISWTKLPVLLKGVQRTDDIEKAIDIGCKGVVLSNHGGRQLDTSPPPIEVMAESVPILKQKGKLDPNFSIFVDGGVRRGTDILKALAIGGRDCKVAVGLGRPFLYANTGYGEKGVRKAVQILREELKADMRMLGVTSLNELDDSYIDTRRLLGRDAVNHIYNNNYYPMSKIQFKNEK

SEQ ID NO: 117 - DNA, 1167 bp, Issatchenkia orientalis
atggtgtcccctgctgaaagattatctactattgcgtccacaatcaagccaaacagaaaagattctacatcattacaaccagaagactatccggaacatccgttcaaggtgacggttgttggttccggtaactgggggtgtacaattgccaaggttatagcggaaaacaccgttgagagacctcgtcaatttcaaagagatgttaatatgtgggtctatgaagaattgattgaaggcgaaaagttgactgaaatcataaataccaaacacgaaaacgtcaagtacttgccaggtatcaagttgccagttaacgttgttgcagttccagacattgttgaggcttgtgcaggctcagacttgattgtctttaatattcctcaccaatttttaccaagaattttatcccaattaaagggtaaggtgaatccaaaggctagagcaatttcttgtttgaaaggtttggatgtcaatcctaatggatgtaagttgctctccactgttattactgaagagttgggtatttattgtggtgccttatcaggtgctaatttagctcctgaagttgcacaatgtaaatggtcggaaacaactgttgcatatacaattccggacgatttcagaggtaaaggcaaggatattgaccatcaaattctaaagagtttgttccatagaccttatttccatgttcgtgttattagtgatgttgcaggtatttccattgccggtgcactcaagaatgtcgttgctatggctgctggatttgtcgaaggtttaggttggggtgataatgcaaaggctgcagtcatgagaataggtttggtggaaaccattcaatttgccaagacttttttcgatggctgtcatgctgcaacctttactcatgaatctgcaggtgttgccgacctaatcactacctgtgccggcggccgtaacgttagagttggtagatatatggcacaacattctgtctctgcaacggaggctgaagaaaagttgttgaatggccaatcctgtcaaggtatccacacaactagggaagtttacgagttcctctccaacatgggcaggacagatgagttcccactatttaccaccacctaccgtatcatctacgaaaacttcccaattgagaagctgccagaatgccttgaacctgtggaagattaa

SEQ ID NO: 118 - protein, 388 aa, Issatchenkia orientalis
MVSPAERLSTIASTIKPNRKDSTSLQPEDYPEHPFKVTVVGSGNWGCTIAKVIAENTVERPRQFQRDVNMWVYEELIEGEKLTEIINTKHENVKYLPGIKLPVNVVAVPDIVEACAGSDLIVFNIPHQFLPRILSQLKGKVNPKARAISCLKGLDVNPNGCKLLSTVITEELGIYCGALSGANLAPEVAQCKWSETTVAYTIPDDFRGKGKDIDHQILKSLFHRPYFHVRVISDVAGISIAGALKNVVAMAAGFVEGLGWGDNAKAAVMRIGLVETIQFAKTFFDGCHAATFTHESAGVADLITTCAGGRNVRVGRYMAQHSVSATEAEEKLLNGQSCQGIHTTREVYEFLSNMGRTDEFPLFTTTYRIIYENFPIEKLPECLEPVED

SEQ ID NO: 119 - DNA, 1566 bp, Issatchenkia orientalis
atgttgtccctctctaaacagtcaagaaactttttcaaattgaactatttttcagtcacccaaatagcaaaaatgtctgcaacttccgtcactttcccaattatcaacgaaacttaccaacagccaaccgggcttttcatcaacaatgaatttgttagtgcaaagtcaggtaagacttttgatgttaacaccccaattgatgagtctctcatttgtaaagtccaacaggccgatgctgaagatgttgaaattgccgttcaagcagcatctaaagcttacaagacttggagatttacaccgccaaatgaaagaggcagatacttgaacaaattggccgatttgatggacgaaaagagagacttacttgccaaaattgaatcccttgataatggtaaggccttacattgtgcaaaattcgatgtcaatcttgtcattgaatatttcagatactgtgcaggttactgtgataaaatcgatggtagaacaattacaaccgatgtagaacattttacctacactagaaaggaacctttaggtgtctgtggtgcaattacaccttggaacttcccattgctgatgtttgcttggaaaatcggcccggctttagcaaccggtaataccattatcttgaagcctgccagtgcaacacctctatcaaacctctttacttgtaccttgatcaaggaggcgggcattccagccggtgttgttaatgttgttccaggttccggtagaggctgtggtaactccattttacaacatcctaaaattaagaaggttgcgtttaccggatctacagaagttggtaaaactgttatgaaggaatgtgctaattccatcaaaaaggttactctcgaattgggtggtaagtctccaaacattgttttcaaagactgtaacgttgaacaaaccattcaaaatttgattactggtattttcttcaatggtggtgaagtctgttgtgctggttctagaatttacattgaagcaaccgatgagaaatggtatactgaattcttgaccaaattcaaggagactgttgaaaaattaaagattggtaacccatttgaagagggtgttttccaaggtgcacaaaccactccagatcaattccaaactgtcttggactacatcaccgctgctaacgaatccagcttgaaactattaactggtggtaaaagaattggcaataagggatactttgttgagccaactatcttctacgatgttcctcaaaattccaagttaactcaagaagaaatctttggtccagttgctgttgttttacctttcaagtccactgaagaattgattgaaaaggcaaatgattccgattttggcttaggttccggtattcacactgaagatttcaacaaggcaatttgggtttccgaaaggcttgaagcaggttctgtttggatcaacacttacaatgatttccacccagctgctccattcggtggttacaaggaatccggtattggcagagaaatgggtattgaagctttcgacaactatactcaaaccaagttagttagagctagagttaacaagccagctttttag

SEQ ID NO: 120 - protein, 521 aa, Issatchenkia orientalis
MLSLSKQSRNFFKLNYFSVTQIAKMSATSVTFPIINETYQQPTGLFINNEFVSAKSGKTFDVNTPIDESLICKVQQADAEDVEIAVQAASKAYKTWRFTPPNERGRYLNKLADLMDEKRDLLAKIESLDNGKALHCAKFDVNLVIEYFRYCAGYCDKIDGRTITTDVEHFTYTRKEPLGVCGAITPWNFPLLMFAWKIGPALATGNTIILKPASATPLSNLFTCTLIKEAGIPAGVVNVVPGSGRGCGNSILQHPKIKKVAFTGSTEVGKTVMKECANSIKKVTLELGGKSPNIVFKDCNVEQTIQNLITGIFFNGGEVCCAGSRIYIEATDEKWYTEFLTKFKETVEKLKIGNPFEEGVFQGAQTTPDQFQTVLDYITAANESSLKLLTGGKRIGNKGYFVEPTIFYDVPQNSKLTQEEIFGPVAVVLPFKSTEELIEKANDSDFGLGSGIHTEDFNKAIWVSERLEAGSVWINTYNDFHPAAPFGGYKESGIGREMGIEAFDNYTQTKLVRARVNKPAF

SEQ ID NO: 121 - DNA, 1506 bp, Issatchenkia orientalis
atgtcagcactgttcagaaccattgagactccaaacggtaaaaccctggaacaaccactgggtctcttcatcgacaatgagtgggtgaaaacaaaccgtacttttgagaccattaatccgtccacaggtgaggcgatctgtcatgtttaccgtgctggggtccaggaggtgaacgacgctgtcgaagctgcaaatagagcatttagaaacgaatcttggtcaggtctaactggttctcaacgtggcgatttactgtatcgcatgtaccaagttatcaaaagagacgccgagagcattgcatcgattgagtccatggataatggtaaaccgtatgctgcagaatgcctagatggagatttaggtgaagctgctgacgttttcaaatattatgccggttgggccgacaagatcaccggtgaactcattggctcgagtgtattgggtaagaataagatgtgttatgtcgagcctacaccactgggtgccgttggcggtatagtcccttggaatttcccgtttaccatgatggcatggaaaattgccccggcactggcgacgggttgtacagtggttatgaagtcaagtgaagtcacaccgttgacggcattatggtatggcaagattgcacttgaagtgggtctacctaaaggtgtacttaacatcctctccggttttggatcggatgttggatcggccatggcttcacatccaaagttggctaagatagcgttcactggctcaactgcaactggtaaaaaaatcatggaagcagcaggtggttccaacttgaaaaaggttacactagagtgtggtggtaaatctccttacattgtttttgatgatgctgacttagaattggcagtagaatgggcatattggggtatttggtataacaaaggtgaggtttgtacttcaacttcgagatttttgattcaggaagacatttacgataagtttgttgagagttttgttgagttgaccaagacgagagcaatcactgctgatccgtttgatgatagatgcactatcgggcctttggtttctagctcacagtacgaaaaagtcaaaaagtacgttgaaataggtaaaaatgaaggagcaaagctactaactggcaaattcatcgacgggccaggctatttctgtgagccatttatcttcagtgaatgcactgacgatatgacaatcatgaaagaggaaatctttggccctgttgtggggattactaaattctcaacggttaaagaggcgatcgagagagccaatgctacgacttacggtttaggagctgcgttgttttcctctaacataacaaaggcacattctgtggctgccaagttggaggctggaatggtgtggatcaattctaatggtgattctgatatccacattccatttggtggttccaaaatgagtggtataggtagggagttggggccatacgcactagacttgtttactgagaaaaaggcagttcatgtcaacttatcgcttccggtcaagtga

SEQ ID NO: 122 - protein, 501 aa, Issatchenkia orientalis
MSALFRTIETPNGKTLEQPLGLFIDNEWVKTNRTFETINPSTGEAICHVYRAGVQEVNDAVEAANRAFRNESWSGLTGSQRGDLLYRMYQVIKRDAESIASIESMDNGKPYAAECLDGDLGEAADVFKYYAGWADKITGELIGSSVLGKNKMCYVEPTPLGAVGGIVPWNFPFTMMAWKIAPALATGCTVVMKSSEVTPLTALWYGKIALEVGLPKGVLNILSGFGSDVGSAMASHPKLAKIAFTGSTATGKKIMEAAGGSNLKKVTLECGGKSPYIVFDDADLELAVEWAYWGIWYNKGEVCTSTSRFLIQEDIYDKFVESFVELTKTRAITADPFDDRCTIGPLVSSSQYEKVKKYVEIGKNEGAKLLTGKFIDGPGYFCEPFIFSECTDDMTIMKEEIFGPVVGITKFSTVKEAIERANATTYGLGAALFSSNITKAHSVAAKLEAGMVWINSNGDSDIHIPFGGSKMSGIGRELGPYALDLFTEKKAVHVNLSLPVK

SEQ ID NO: 123 - DNA, 1506 bp, Issatchenkia orientalis
atggctcttccacttgcaactacaatctccttatcaagcggcaaaacattagaacagccaattggtttatttattgataatgaatttgtcaatccaatttctgtttctaatgcaagaacactaacaaccttcaacccaagcacaggtgagccaataaccgatgttcattgtgcctcagctgcagatgttgatgttgcggtaaatgctgcaaacaaggcaatggaaacatggaaagacattgatcctactgttcgtgtcgaacttttactaaaattggccagcttagttgacgagcattcccaagcaattgctgaaattgaagcactagactcgggtaaaccattgtactcgaatgcactggcggatgttcaatcggttgctgagtacttaaggtactgtgccggttgggcggataaattacacggtacgcaaattccaataaactctaaggtaatggctattacaaaacgtgtacccttagttgtcggctgcatcattccatggaactacccaatttcaatggcctcctggaagttctgtccagcattggctgccggatgtactattgtaatgaagtcaagtgagataaccccgttatcgttactttattttgcgaatttggtcaaattagcaggtttccctaagggtgtttttaatgtcgtctctggatttggtgatgatgttggctcagcgctttcaaatcacccaaagttgggtaagattgcatttacaggctcgaccttgaccgggcaaaaggtgatggcggatgctgccagatcaaatttgaaaagcgtatctttggaatgtggtggtaaatctccacttattgtcttcgaagatgcagaattggatgaatgcgttaaatgggcaagttttggtgtcatgtataacaccggacaaaattgtactgccaattctcgtattattgtgcatgataaggtttatgatcaatttatcgaaaagttcctgtctcaactcaaggaagattggaaaatgggagatgtcatgaatgaaaagactacattgggaccacttgtcagccaacaacaatatgagcgtgttcagtcgtatattgatataggtgtcaaagaaggggctacactgattcaaccgcttaaggagagcactccatcaaatggattctacatctctcctactgtttttactaacgttaaggaagatatgagaattgttaaggaggaaatatttggtcctgtcgtaactatctccaaattctcaactgaggaagaggcaatttcaaaggcgaatgatacaatttatggcttagctgcaatgttatttactactaattttgaacgtgccaacagagttgctgataagctggaagctggcagtgtgtacattaatagctctaacaacgagagtaccaaagttccatttggaggaatgaagatgagtggtattggaagagagttggggcaagaagcatttaatttgtacactgttacaaagagtatttattatagttatggtgctaagctttaa

SEQ ID NO: 124 - protein, 501 aa, Issatchenkia orientalis
MALPLATTISLSSGKTLEQPIGLFIDNEFVNPISVSNARTLTTFNPSTGEPITDVHCASAADVDVAVNAANKAMETWKDIDPTVRVELLLKLASLVDEHSQAIAEIEALDSGKPLYSNALADVQSVAEYLRYCAGWADKLHGTQIPINSKVMAITKRVPLVVGCIIPWNYPISMASWKFCPALAAGCTIVMKSSEITPLSLLYFANLVKLAGFPKGVFNVVSGFGDDVGSALSNHPKLGKIAFTGSTLTGQKVMADAARSNLKSVSLECGGKSPLIVFEDAELDECVKWASFGVMYNTGQNCTANSRIIVHDKVYDQFIEKFLSQLKEDWKMGDVMNEKTTLGPLVSQQQYERVQSYIDIGVKEGATLIQPLKESTPSNGFYISPTVFTNVKEDMRIVKEEIFGPVVTISKFSTEEEAISKANDTIYGLAAMLFTTNFERANRVADKLEAGSVYINSSNNESTKVPFGGMKMSGIGRELGQEAFNLYTVTKSIYYSYGAKL

SEQ ID NO: 125 - DNA, 1544 bp, Issatchenkia orientalis
  misc_feature (1319)..(1319): N= A, C, G, OR T
atgatgggcgcaactacagcaaaaattagtattccaaatggtaacaaatacgagcaacctacaggtttgttcatcaatggtgagtttgttgcttcaagtgatggtaaaactgcagaagttgagaatccaggcaatggaaacattgtatgttctgtccacttagcttctattgaggatattaataccgccgtagaagctgctgaagatgcatttttcaaaaggtgggccaccatcagtggtaaagccaagggagaatacttgagtaagattgccgatctaatcgttaaatattctgatcaattggcagatctagaggctattgaatcaggtaagccaaaggacaccaatgcaatctttgatgttttacattcggctgatgttttcagatactatgctggcaaggctgtcactgcacaaagcggcaagactatcgagtccgaactctccaaatttacatacacagtttacgagccctatggtgtttgtgccgctatcatcgcatggaacttcccaatgagcacatttgcgtggaaagttgcggcatgtttagctgctggtaatacaatggttgtcaaaacttccgagctgactccgttatctgcattgttcatgtgtaagattttccaagaagcagatctacctgctggagttataaacgtcacatgtggtttaggttctgttgcaggtgttcgattgagtgaacatgaaaaggttcagaaaatttcgtttactggctccactggcgttggtaagttgatccaagaatccgcagcaaagtctaacttaaagtattgtacgcttgaatgtggtggtaagtctccgttagtgatttacgaggatgcagatcttgagcaagcagtgaagtgggctgcctttggtatttttttcaacaaaggtgaaatttgcacagcctcttccagaatatatgttcaagaatcagtctatgacaaatttttgactatgtacaaggatcatgtggaagaagcctatgttcaaggagaacagtttgccactggtgttaacgttgggcctactgtctgcaaagcccaacaagagaaaatactggcctacattgaaagtgccaagcaagaaggtggtagaattatcactggtggtaaaataccatcttacacgaacaaaaatggttactatctcgaaccaacaattattgcagattgtaaccaggatatgaaggtagtcagggaagagattttcggaccagtcgttactgtatccaaattcactagtgatgaagaagccatcaaattaagcaatgattccgaatatggcttggcagcatatttattcactystsrasnassrgttyrgytaaaatyrththraaggacctcgttagatctcagaattatatcagaaaagtgcaaagcggacaggtctttgtcaacttcacctttgcggctgatttcaggttgccatttggcggatataagatgagtggtaacggaagagagcttggtgatgaaggactgagtgctttccagcaagtcaaagcagtacacattaatctcactgggaagttgtaa

SEQ ID NO: 126 - protein, 503 aa, Issatchenkia orientalis
MMGATTAKISIPNGNKYEQPTGLFINGEFVASSDGKTAEVENPGNGNIVCSVHLASIEDINTAVEAAEDAFFKRWATISGKAKGEYLSKIADLIVKYSDQLADLEAIESGKPKDTNAIFDVLHSADVFRYYAGKAVTAQSGKTIESELSKFTYTVYEPYGVCAAIIAWNFPMSTFAWKVAACLAAGNTMVVKTSELTPLSALFMCKIFQEADLPAGVINVTCGLGSVAGVRLSEHEKVQKISFTGSTGVGKLIQESAAKSNLKYCTLECGGKSPLVIYEDADLEQAVKWAAFGIFFNKGEICTASSRIYVQESVYDKFLTMYKDHVEEAYVQGEQFATGVNVGPTVCKAQQEKILAYIESAKQEGGRIITGGKIPSYTNKNGYYLEPTIIADCNQDMKVVREEIFGPVVTVSKFTSDEEAIKLSNDSEYGLAAYLFTKDLVRSQNYIRKVQSGQVFVNFTFAADFRLPFGGYKMSGNGRELGDEGLSAFQQVKAVHINLTGKL

SEQ ID NO: 127 - DNA, 1716 bp, Issatchenkia orientalis
  misc_feature (655)..(655): n is a, c, g, or t
atggctccaactgctgttgatatccataacgagtacaaacagaatgtttccaacgaacaggaaattcctttcaacaaaactgaaagaaagtcatcgattgcatctaaattaggactgaatccagacgctaagattcactacaattctgctgttcctatattatacgaagatggtttaaaggaaaaaggtacaaccatttcctcttctggtgcattgattgcattctctggttccaaaacaggtagatctccaaaggacaaaagaattgtcgatgaagagacttcaacagacaacatctggtggggtccagtcaataagaaggttgatgaaaacacttggaatatctcgaaatctagagcgattgattatttgagaacaagagagaaggtttacattatcgatgcttttgctggttgggatccaagatacagaattaaggttagaattgtctgtgctagagcttaccatgctttgttcatgaagaatatgttaattagaccaacaacggaagaattaaagaactttggtgagcctgatttcaccatttggaatgcaggtcaattccctgctaatgtttacactaagggtatgacttcttcaacttctgttgaaataaatttcaagtctthrysgymtthrsrsrthrsrvagtasnhyssratggaaatggttatcctaggtactgaatacgcaggtgaaatgaagaaaggtatctttaccgttatgttctacttgatgccaatcagacacaaggttttaactttacactcttctgcaaatcaaggtaaaaaggatggtgatgtcacattattctttggtttatctggtacaggtaaaacaaccttgtctgcagatcctcatagagaattgattggtgatgatgaacattgctggtctgatcatggtgttttcaacattgaaggtggatgttatgctaagtgtttggacttatctgctgaaagagaacctgagattttcaatgcaattaggtttggatctgtcttggagaatgttgtctatgatccagttgatagaactgttgactattccgctgctaatgtcactgaaaatactagatgtgcttatcctatcgactttattccttctgctaagatcccatgtctggcagattctcatccaaagaatattgttcttttaacttgtgatgcaagaggtgttttgccacctgtctccaagctaactaatgcacaagtcatgtatcactttatctctggttacacctccaagatggcaggtaccgaagttggtgtcactgaaccagaagcaaccttctctgcatgttttggtcaacctttcttagttttacatccaatgaaatacgcacaacaactctctgataaaatggctgaacattcttccaccgcttggttattgaataccggttggactggtcaatcttatgttaaaggtggtaagagatgtccattgaagtatactagagcaattttagatgctattcactctggtgagcttgcaaaacaggaattcgaaacataccctactttcggtttacaagttccaaaaacttgtccaggtgtcccagaaagtgttctgaacccatctaaacactgggctactggtgaagctgatttcaaggctgaagtcactaacttggctaaattatttgctgagaactttgaaaagtattctgcagaatgtactgcagaagttgttgctgctggtcctgctttataa

SEQ ID NO: 128 - protein, 560 aa, Issatchenkia orientalis
MAPTAVDIHNEYKQNVSNEQEIPFNKTERKSSIASKLGLNPDAKIHYNSAVPILYEDGLKEKGTTISSSGALIAFSGSKTGRSPKDKRIVDEETSTDNIWWGPVNKKVDENTWNISKSRAIDYLRTREKVYIIDAFAGWDPRYRIKVRIVCARAYHALFMKNMLIRPTTEELKNFGEPDFTIWNAGQFPANVYTKGMTSSTSVEINFKSMEMVILGTEYAGEMKKGIFTVMFYLMPIRHKVLTLHSSANQGKKDGDVTLFFGLSGTGKTTLSADPHRELIGDDEHCWSDHGVFNIEGGCYAKCLDLSAEREPEIFNAIRFGSVLENVVYDPVDRTVDYSAANVTENTRCAYPIDFIPSAKIPCLADSHPKNIVLLTCDARGVLPPVSKLTNAQVMYHFISGYTSKMAGTEVGVTEPEATFSACFGQPFLVLHPMKYAQQLSDKMAEHSSTAWLLNTGWTGQSYVKGGKRCPLKYTRAILDAIHSGELAKQEFETYPTFGLQVPKTCPGVPESVLNPSKHWATGEADFKAEVTNLAKLFAENFEKYSAECTAEVVAAGPAL

SEQ ID NO: 129 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 130 - DNA, 420 bp, Streptomyces avermitilis
atgttaagaaccatgttcaaatctaagattcacagagcaactgttactcaagcagatctccattatgttggttccgttactattgatgcagacttgttagacgcagcagacttgttgccaggtgaattggttcacatcgttgacattacgaacggtgctagattggaaacttacgtcattgaaggtgaacgtggttccggtgttgttggtatcaatggtgctgccgctcatttagttcatcctggtgatcttgttatcattatctcctatgcacaagtttcagatgcagaagcacgtgcattgcgtccaagagttgttcacgttgacagagacaatagagttgttgcgcttggtgcggatccagccgaaccagtcccaggttccgaccaagctagatccccacaagctgttactgcataa

SEQ ID NO: 131 - DNA, 384 bp, Clostridium acetobutylicum
atgcacttgaacatgttgaagtccaagatccacagagctaccgtcgttcaagcagacttgaactacgtcggttccatcaccatcgacagaaacttgatggacaaggcaaacatcttggaatacgaaaaggtcgagatcgcaaacatcaacaacggtgcaagattcgaaacctacgtcatcgctggtgaggctggttccggtatcatctgtttgaacggtgctgctgcaagatgtgcacaagcgggtgacaaggttatcatcatgtgttactgttccttgaccccagaagaagcttccgagcacagaccaaaggtcgttttcgtcaacgacgacaactccatctccaacgtcaccgaatacgagaagcacggcaccatcggttaa

SEQ ID NO: 132 - DNA, 354 bp, Helicobacter pylori
atgaccttcgagatgttgtactccaagatccacagagcaaccatcaccgacgcaaacttgaactacatcggctccatcaccatcgacgaggacttggctaagttggctaagttgagagagggtatgaaggtcgaaatcgtcgacgtcaacaacggcgagagattctccacctacgtcatcttgggtaagaagagaggtgaaatctgcgtcaacggtgcagcagccagaaaggtcgctatcggtgacgtcgtcatcatcttggcttacgcatccatgaacgaggacgagatcaacgctcacaagccatccatcgtcttggtcgacgaaaagaacgaaatcttggaaaagggttaa

SEQ ID NO: 133 - protein, 117 aa, Helicobacter pylori
MTFEMLYSKIHRATITDANLNYIGSITIDEDLAKLAKLREGMKVEIVDVNNGERFSTYVILGKKRGEICVNGAAARKVAIGDVVIILAYASMNEDEINAHKPSIVLVDEKNEILEKG

SEQ ID NO: 134 - DNA, 387 bp, Bacillus sp. TS25
atgtacagaaccatgatgaagtccaagttgcacagagcgaccgtcaccgaagcaaacttgaactacgtcggttccatcaccatcgaccaagacttgatggaagctgcagacatcttggaaaacgagaaggtccaaatcgtcaacaacaacaacggtgctagattcgaaacctacgtcatcgctggtccaagaggctccggcaccatctgtttgaacggtgcagcagcaagattggtccaaccaggtgacaccgttatcatcatctcctacgcaatgttggaagaagccgaggctagaaagcaccaacctgtcgtcgttttgttgaacccagacaacaccatccaagaattgatcagagaaacccacggtgctaccgctaccgtctaa

SEQ ID NO: 135 - protein, 128 aa, Bacillus sp. TS25
MYRTMMKSKLHRATVTEANLNYVGSITIDQDLMEAADILENEKVQIVNNNNGARFETYVIAGPRGSGTICLNGAAARLVQPGDTVIIISYAMLEEAEARKHQPVVVLLNPDNTIQELIRETHGATATV

SEQ ID NO: 136 - DNA, 411 bp, Corynebacterium glutamicum
atgttgagaaccatcttgggttccaaaatccacagagctaccgttacccaagcagacttggactacgttggttcagtcaccatcgatgcagacttggttcatgccgcaggtttgatcgaaggtgaaaaggttgccatcgtcgacatcaccaatggcgctagattggaaacctacgttatcgttggtgatgctggcaccggtaacatctgtatcaacggtgcagcagcacacttgatcaacccaggtgatttggttatcatcatgtcctacttgcaagctaccgatgcagaggccaaggcttacgaaccaaagatcgttcacgtcgacgcagacaacagaatcgttgctttgggtaacgacttggcagaagctttgcctggttccggtttgttgacctcaagatctatctaa

SEQ ID NO: 137 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 138 - DNA, 384 bp, Bacillus licheniformis
atgtacagaaccttgatgtccgctaagttgcacagagctagagtcaccgaagcaaacttgaactacgttggttccgtcaccatcgacgaggacttgttggacgcagtcggtatgatggcaaacgaaaaggtccaaatcgtcaacaacaacaacggtgctagattggaaacctacatcatccctggtgagagaggttccggtgtcgtctgtttgaacggtgctgcagctagattggtccaagttggtgacgtcgttatcatcgtttcctacgccatgatgtccgaagaagaagcaaagacccacaagccaaaggtcgctgttttgaacgaaagaaacgaaatcgaagagatgttgggtcaagaaccagctagaaccatcttgtaa

SEQ ID NO: 139 - protein, 127 aa, Bacillus licheniformis
MYRTLMSAKLHRARVTEANLNYVGSVTIDEDLLDAVGMMANEKVQIVNNNNGARLETYIIPGERGSGVVCLNGAAARLVQVGDVVIIVSYAMMSEEEAKTHKPKVAVLNERNEIEEMLGQEPARTIL

SEQ ID NO: 140 - DNA, 1356 bp, Streptomyces avermitilis
atgacaccacagccaaacccacaagtcggtgcagcagtcaaagctgcagatagagcacacgtcttccactcttggtctgcacaagaattgatcgatccattggctgttgctggtgcagagggttcctacttctgggattacgatggtagacgttaccttgacttcacctccggcttagtcttcaccaacatcggttaccaacacccaaaggttgtcgcagctatccaagaacaagccgcatctttgactacatttgccccagctttcgcagttgaagcaagatccgaagctgcaagattgatcgctgagcgtactccaggtgatttagacaaaatcttcttcaccaacggtggcgcagatgctatcgagcacgctgttcgtatggcaagaatccacgctggtagaccaaaggtcttatccgcatacagatcataccacggtggtacacaacaggcagtcaacatcactggtgatccaaggagatgggcatccgattccgcttctgctggcgttgtccacttctgggctccatacttatacagatccagattctacgccgaaactgagcaacaagaatgtgagcgtgctcttgagcacttggaaactactatcgccttcgaaggtccaggtactattgccgctatcgttttggaaactgtcccaggtactgctggtatcatggttcctccaccaggttacttagcaggtgttagagaattgtgtgacaaatacggtatcgtcttcgtcttggatgaagtcatggctggtttcggcagaactggcgaatggttcgctgcagacttattcgatgttaccccagacttgatgaccttcgctaagggtgtcaactcaggttacgttccattgggtggtgttgctatctccggcaaaatcgcagagactttcggtaagagagcttacccaggtggtttgacgtactccggtcaccctcttgcttgcgcagccgctgttgctactatcaacgttatggcagaagaaggtgtcgttgaaaacgctgcaaacttgggtgctagagttatcgaaccaggtttgagagaacttgcagagagacacccatcagttggtgaagttagaggtgttggtatgttctgggctttggaattggttaaggatagagaaaccagagaacctttggtcccatacaatgccgctggtgaagcgaacgcaccaatggctgctttcggtgcagctgcaaaggcaaacggtttgtggccattcatcaacatgaacagaacccacgttgttcctccttgtaacgttaccgaagccgaagctaaagaaggcttggcagcattggatgcagctttatctgttgcagatgagtacactgtctaa

SEQ ID NO: 141 - DNA, 1416 bp, Saccharomyces cerevisiae
atgtccatctgtgagcaatactacccagaagaaccaaccaagccaaccgtcaagaccgaatccatccctggtccagaatcccaaaagcaattgaaggaattgggtgaagttttcgacaccagaccagcttacttcttggcagactacgaaaagtccttgggtaactacatcaccgacgtcgacggtaacacctacttggacttgtacgctcaaatctcctccatcgccttgggttacaacaacccagcattgatcaaagccgctcaatccccagaaatgatcagagcattggttgacagaccagccttgggtaacttcccttccaaggacttggacaagatcttgaagcaaatcttgaagtccgctccaaagggtcaggaccacgtctggtccggtttgtccggtgcagacgcaaacgaattggctttcaaggctgcattcatctactacagagctaagcaaagaggttacgacgcagacttctccgaaaaggaaaacttgtccgttatggacaacgacgcaccaggtgctccacacttggcagttttgtccttcaagagagctttccacggtagattgttcgcatccggttccactacctgttccaagccaatccacaagttggacttccctgctttccactggccacacgccgaatacccatcctaccagtaccctttggacgaaaactccgacgcaaacagaaaggaggacgaccactgcttggcaatcgttgaagaattgatcaagacctggtccatccctgttgctgcgttgatcatcgaaccaatccaatccgagggtggtgacaaccacgcctccaagtacttcttgcaaaagttgagagacatcaccttgaagtacaacgtcgtctacatcatcgacgaagtccaaactggcgttggcgcaaccggtaagttgtggtgtcacgaatacgcagacatccagcctccagtcgacttggtcaccttctccaagaagttccaatccgctggctacttcttccacgaccctaagttcatcccaaacaagccatacagacaattcaacacctggtgtggtgaaccagcaagaatgatcatcgcaggtgcaatcggtcaagagatctccgacaagaagttgaccgaacaatgctccagagtcggtgactacttgttcaagaagttggaaggtttgcaaaagaagtacccagagaacttccaaaacttgagaggtaagggtagaggcaccttcatcgcttgggacttgccaactggcgagaagagagacttgttgttgaagaagttgaagttgaacggctgtaacgttggtggctgtgctgttcacgcagtcagattgagaccttccttgaccttcgaagagaagcacgcagacatcttcatcgaagctttggctaagtccgtcaacgaattgtaa

SEQ ID NO: 142 - DNA, 1428 bp, Saccharomyces kluyveri
atgccatcctactccgttgcagaattgtactacccagacgaacctaccgaacctaagatctccacctcctcctacccaggtccaaaggcaaagcaagaattggaaaagttgtccaacgtcttcgacaccagagcagcttacttgttggcagactactacaagtcccgtggtaactacatcgttgaccaggacggtaacgtcttgttggacgtttacgctcaaatctcctccatcgccttgggttacaacaacccagaaatcttgaaggttgcaaagtccgacgcaatgtccgttgcattggccaaccgtccagcattggcttgtttcccatccaacgactacggtcaattgttggaagacggtttgttgaaggcagcaccacaaggtcaagacaagatctggaccgctttgtccggttccgacgcaaacgaaaccgccttcaaagcctgcttcatgtaccaagctgcgaagaagagaaacggtagatccttctccaccgaagaattggaatccgttatggacaaccaattgccaggcacctccgaaatggttatctgttccttcgaaaagggtttccacggtcgtttgttcggttccttgtccactaccagatccaagcctatccacaagttggacatcccagctttcaactggcctaaagccccattcccagacttgaagtacccattggaagaaaacaaggaagccaacaaggctgaagaatcctcctgtatcgaaaagttctcccaaatcgttcaagagtggcaaggtaagatcgctgcagttatcatcgaaccaatccagtccgagggtggcgacaaccacgcttcctccgacttcttccaaaagttgagagaaatcaccatcgaaaacggtatcttgatgatcgtcgacgaagttcaaaccggtgtcggtgctaccggcaagatgtgggcacacgaacactggaacttgtccaaccctccagacttggttaccttctccaagaagttccaagcagcaggtttctactaccacgacccaaagttgcaaccagaccagccattcagacagttcaacacctggtgtggtgacccatccaaggctttgatcgccaaggttatctacgaagaaatcgttaagcacgacttggtcaccagaactgccgaagtcggtaactacttgttcaacagattggaaaagttgttcgaaggtaagaactacatccagaacttgagaggtaagggtcaaggcacctacatcgctttcgacttcggcacctcctccgagagagactccttcttgtccagattgagatgtaacggtgcaaacgtcgctggttgcggtgactccgctgtcagattgagaccatccttgaccttcgaagagaagcacgcagacgtcttggtttccatcttcgacaagaccttgagacaattgtacggctaa

SEQ ID NO: 143 - DNA, 747 bp, Escherichia coli
atgatcgttttggtcaccggtgcaaccgcaggtttcggcgaatgtatcaccagaagattcatccagcagggtcacaaggttatcgctaccggtagaagacaagagagattgcaagaattgaaggacgagttgggtgacaacttgtacatcgctcaattggacgttagaaacagagcagctatcgaagaaatgttggcatccttgccagctgaatggtgcaacatcgacatcttggtcaacaacgctggtttggcattgggtatggaaccagctcacaaggctagtgttgaggactgggagaccatgatcgacaccaacaacaagggtttggtctacatgaccagagcagttttgcctggtatggttgaaagaaaccacggtcacatcatcaacatcggttccaccgctggttcctggccatacgctggcggtaacgtctacggtgctaccaaggctttcgttagacagttctccttgaacttgagaaccgacttgcacggcaccgctgttagagttaccgacatcgaaccaggtttggttggtggcaccgaattctccaacgtcagattcaagggcgacgacggtaaggctgaaaagacctaccaaaacaccgtcgctttgaccccagaagacgtttcagaggctgtttggtgggtcagtaccttgccagcacacgtcaacatcaacaccttggaaatgatgccagtcacccaatcctacgcaggtttgaacgttcacagacaataa

SEQ ID NO: 144 - DNA, 804 bp, Saccharomyces cerevisiae
atgtcccaaggtagaaaggcagcagaaagattggcaaagaagaccgtcttgatcaccggtgcgtccgctggtatcggtaaggctaccgcgttggagtacttggaagcatccaacggtgacatgaagttgatcttggcagcaagaagattggagaagttggaagaattgaagaagaccatcgaccaagaattcccaaacgctaaggtccacgttgcacaattggacatcacccaagcagagaagatcaagccattcatcgaaaacttgccacaagaattcaaggacatcgacatcttggtcaacaacgctggtaaggcgttgggttccgacagagttggtcaaatcgcaaccgaagacatccaagacgtcttcgacaccaacgtcaccgctttgatcaacatcacccaagctgttttgccaatcttccaagcgaagaactccggtgacatcgtcaacttgggttccatcgctggtagagacgcatacccaaccggctccatctactgcgcctccaagttcgctgtcggtgctttcaccgactccttgagaaaggaattgatcaacaccaagatcagagtcatcttgattgcccctggtttggtcgaaaccgaattctccttggttagatacagaggtaacgaagaacaagcaaagaacgtttacaaggacactaccccattgatggccgacgacgttgcagacttgatcgtttacgctacctccagaaagcaaaacaccgttatcgcagacaccttgatcttcccaaccaaccaagcatccccacaccacatcttcagaggttaa

SEQ ID NO: 145 - DNA, 420 bp, Streptomyces avermitilis
atgcttagaaccatgttcaaatccaagatccacagagcaaccgtcactcaagcagatttgcattacgttggttctgttactattgacgcagacttacttgatgcagccgatttacttcctggtgagcttgttcatattgttgatatcaccaatggtgcgcgtcttgaaacctatgtcattgagggtgaacgtggttccggtgtcgtcggtatcaatggcgcagctgcacacctcgtccatccaggtgacctggtcatcatcatttcttatgcacaggtctccgatgctgaagcccgtgccttaagaccaagagtcgttcacgtcgacagagataacagagttgtcgctttaggtgcagacccagcagagccagttccaggttccgatcaagctagatcaccacaggctgttaccgcctaa

SEQ ID NO: 146 - DNA, 420 bp, Streptomyces avermitilis
atgttaagaactatgtttaagtccaagattcacagagctaccgtcacccaagcagatttgcattacgtcggttccgttaccattgatgcagatttactcgatgcggcagacttgttacctggtgaactagttcacattgttgacattaccaatggtgctagattggaaacttacgtcattgaaggtgaaagaggtagtggtgtcgttggtatcaatggtgcagctgctcacttagttcacccaggtgacttagtcatcatcatttcatatgcacaagtttccgatgcggaagctagagcattaagaccaagagttgttcatgttgatagagacaacagagtcgttgcacttggtgcagatcctgctgaaccagttccaggttcagatcaagctaggtctccacaagcagttactgcataa

SEQ ID NO: 147 - DNA, 420 bp, Streptomyces avermitilis
atgttaagaactatgttcaagagtaagattcatagggctaccgttacccaggcagatctacattatgttggttctgttaccattgacgcagatttgttggatgcagcagacttgttaccaggtgaactcgttcacattgtcgatatcaccaacggtgccagactggaaacttatgtcattgaaggtgagagaggcagtggtgttgtcggcattaacggtgccgcagcacacttggttcatccaggtgacttggtcatcatcatttcttacgcacaagtctccgatgccgaagctagagcattgagacctagagtcgttcacgttgacagagacaatagagttgttgctcttggtgcagatccagctgagccagttccaggttccgatcaagcgagatctcctcaagctgttactgcataa

SEQ ID NO: 148 - DNA, 384 bp, Bacillus licheniformis
atgtatagaaccttgatgagtgcaaagcttcacagagcaagagtcactgaagcaaacttgaactacgttggttctgttactattgacgaagacttacttgatgcagtcggtatgatggcaaacgagaaagttcaaattgtcaacaataacaatggtgcgcgtcttgaaacctatatcattcctggtgaacgtggttccggtgtcgtctgcttgaatggcgcagctgcaaggctcgtccaagttggtgacgtcgtcatcattgtttcttatgcaatgatgtccgaagaagaagccaaaacacataagccaaaggtcgctgtcctcaatgaaagaaacgaaattgaggaaatgttaggtcaggaaccagcgagaaccatcttataa

SEQ ID NO: 149 - DNA, 384 bp, Bacillus licheniformis; identical to SEQ ID NO: 148

SEQ ID NO: 150 - DNA, 384 bp, Bacillus licheniformis
atgtacagaacgttaatgtctgccaagttacacagagcgagagttactgaagcaaatctcaactatgttggttcagttaccattgatgaggatctattggatgctgttggtatgatggcaaatgaaaaggttcaaatcgtcaataacaacaatggtgctagattagaaacttacatcattcctggtgaaagaggttcaggtgttgtttgcttaaacggtgctgccgcaagattagttcaagtcggtgatgttgttatcatcgtctcttatgctatgatgagtgaggaagaagctaagactcataagcctaaggttgccgttctcaatgagagaaacgaaatcgaagaaatgcttggccaagaacctgccagaaccatcctgtaa

SEQ ID NO: 151 - DNA, 384 bp, Bacillus licheniformis
atgtatagaacattgatgtctgcaaagttgcatagggctcgtgttactgaggcaaatctaaactacgtcggttccgtcacaatcgatgaagatctactcgatgccgttggtatgatggccaatgaaaaagttcaaattgtcaacaacaacaacggtgcaagattggagacctatatcattcctggtgaaagaggttcaggtgttgtttgtctgaacggtgctgctgcgaggttggtccaagtcggtgatgttgtcattatcgtttcttatgcaatgatgtcagaagaagaagctaagacccataagccaaaggttgctgttttgaacgaaagaaatgagattgaggaaatgttaggtcaagaaccagcaagaacaatcttataa

SEQ ID NO: 152 - DNA, 945 bp, Metallosphaera sedula
atgaccgaaaaggtctccgtcgtcggtgcaggcgtcatcggtgtcggttgggctaccttgttcgcttccaagggttactccgtctccttgtacaccgaaaagaaggaaaccttggacaagggtatcgaaaagttgcgtaactacgtccaagtcatgaagaacaactcccaaatcaccgaagacgtcaacaccgtcatctccagagtttcccctactaccaacttggacgaagccgttagaggtgcaaacttcgtcatcgaggctgtcatcgaagactacgacgctaagaagaagatcttcggttacttggactccgtcttggacaaggaagttatcttggcatcctccacctccggtttgttgatcaccgaagtccaaaaggctatgtccaagcacccagaaagagctgtcatcgcccacccatggaacccaccacacttgttgcctttggtcgaaatcgttccaggtgagaagacctccatggaagtcgttgagagaaccaagtccttgatggaaaagttggacagaatcgtcgtcgttttgaagaaggaaatcccaggtttcatcggtaacagattggcattcgctttgttcagagaagctgtctacttggttgacgagggtgtcgcaaccgtcgaggacatcgacaaggttatgactgccgctatcggcttgagatgggccttcatgggtccattcttgacctaccacttgggtggtggtgagggtggtttggaatacttcttcaacagaggtttcggttacggtgccaacgaatggatgcacaccttggctaagtacgacaagttcccatacaccggtgtcaccaaggccatccagcaaatgaaggaatactccttcatcaagggtaagaccttccaagagatctccaagtggagagacgaaaagttgttgaaggtctacaagttggtctgggaaaagtaa

SEQ ID NO: 153 - DNA, 1728 bp, Issatchenkia orientalis; identical to SEQ ID NO: 48

SEQ ID NO: 154 - protein, 575 aa, Issatchenkia orientalis; identical to SEQ ID NO: 49

SEQ ID NO: 155 - DNA, 1167 bp, Artificial Sequence; identical to SEQ ID NO: 117
  Artificial DNA Sequence

SEQ ID NO: 156 - protein, 388 aa, Artificial Sequence; identical to SEQ ID NO: 118
  Artificial Sequence

SEQ ID NO: 157 - DNA, 1683 bp, Artificial Sequence
  Artificial DNA Sequence
atgccagccaacggaatgttcgacgtcgctctgcaggtcatcgacgactccaacgtgtctagtggatcggacagtgctggtgtgtctgaagatgaagatgttcaactgttttgcagtaaagggaataccatagtcccgaagccgttgaaaaaatccatatcgaaaatcaaggatgaagagttcagcaaaaccgccaaagcaaacgagaaacgatacgcaagtcttccgagccgtgaacatcaccagcaattcttgaccgacttcctgtcggaagtgctgaacaatgccgttttcaacgctaccgaacgggctaacaaagttctgaactgggtggatccggagcagctcaagcgaaccttggacctggaactgaaggacgagcccgattcacatgagaagctgctggaactgaccagggccaccataaagcactcggtcaaaaccggacatccctacttcatgaaccaactgttctcgtccgtcgatccgtacgggttcgctggacagatccttaccgatgcgttgaaccccagtgtctacacgttcgaagtgtctccggtgttcgtcctgatggaggaagtggtgctcaaagaaatgagaaccatcgttggctacccggacggaaccggagatggcattttctgcccaggtggttcgatggctaacggctattccattagctgtgcccgcttcaaacacatgcccgatgtcaagacaaaaggattacattcacttccgcgcttggtaatcttcacatctgaagacgctcattattcggtgaaaaaattggcatcgttcatgggcatcggctcggacaacgtgtacccaatccatacggacgccatcggcaagatcagagtggatcatctagagtcggaaattctgcgcgccaaatcggagggagccgtgccgtttatggtgtcggccaccgcaggaacaacagtgatcggagcgtttgatccgctggagcagatcgcagatctgtgcaaaaagtacaacctctggatgcacgtggatgccgcctggggtggtggtgcacttatgtccaagaagtaccgatcgctgcttaaaggaatcgaacgatcggactcggtcacctggaacccacacaaattgctcgccgctccgcagcaatgctccaccttcctgacccgccacgagggaatcctatcggagtgccactcgaccaacgcgacctatctcttccagaaggacaaattctacgacacccagtacgacaccggcgataagcacatccagtgtggtcgccgtgccgacgtcctcaaattttggttcatgtggcgtgccaagggcacttccgggctggaacagcacatcgacaaggtgttcgagaatgcggagcacttcaccagcagtattaaatcgcgagaaggttttgaaatggtcgtcgagaatcccgagtgtaccaacgtgtgcttctggtacgtgccacctggattgcggaacgtaccacgtgacagcgcagagttcaccgaacggctgcacaaggttgcccccaaggtcaaggaacgcatgatgcgggaaggttcgatgatgatcacataccaaccgatccacgataagcccaacttcttccgattggtcctgcagaactcggccctggacaaatcggacatgaactacatcatcgatgaaatcgaacgacttgctgcagatttgtaa

SEQ ID NO: 158 - DNA, 1683 bp, Artificial Sequence
  Artificial DNA Sequence
atgccagccaacggtatgttcgacgttgcattgcaagttatcgacgactccaacgtctcctccggttccgactccgctggtgtctccgaagacgaagacgtccaattgttctgttctaagggcaacaccatcgtcccaaagccattgaagaagtccatctccaagatcaaggacgaagaattctccaagaccgctaaggcaaacgaaaagagatacgcctccttgccatccagagagcatcaccagcaattcttgaccgacttcttgtccgaagttttgaacaacgcagttttcaacgctaccgaaagagcaaacaaggtcttgaactgggttgacccagaacaattgaagagaaccttggacttggaattgaaggacgaaccagactcccacgaaaagttgttggaattgaccagagcaaccatcaagcactccgttaagaccggtcacccatacttcatgaaccaattgttctcctccgtcgacccatacggtttcgctggtcaaatcttgaccgacgctttgaacccatccgtctacaccttcgaagtttccccagtcttcgttttgatggaagaagtcgttttgaaggaaatgagaaccatcgttggttacccagacggcaccggtgacggtatcttctgtccaggtggttccatggcaaacggttactccatctcctgtgcaagattcaagcacatgccagacgttaagaccaagggtttgcactccttgccaagattggtcatcttcacctccgaagacgcccactactccgtcaagaagttggcttccttcatgggtatcggctccgacaacgtctacccaatccacaccgacgcaatcggcaagatcagagtcgaccacttggaatccgaaatcttgagagccaagtccgaaggtgcggttcctttcatggtctccgctactgctggcactaccgttatcggtgcattcgacccattggaacaaatcgcagacttgtgcaagaagtacaacttgtggatgcacgtcgacgctgcttggggtggtggtgctttgatgtccaagaagtacagatccttgttgaagggtatcgaaagatccgactccgttacctggaacccacacaagttgttagccgcacctcaacaatgttccaccttcttgaccagacacgaaggtatcttgtccgaatgtcactccaccaacgcaacctacttgttccaaaaggacaagttctacgacacccaatacgacaccggtgacaagcacatccaatgtggtagaagggcagacgtcttgaagttctggttcatgtggcgtgccaagggcacctccggtttggaacaacacatcgacaaggttttcgaaaacgctgaacacttcacctcctccatcaagtccagagaaggtttcgaaatggttgttgagaacccagaatgtaccaacgtctgtttctggtacgtcccaccaggtttgagaaacgtccctagagactccgctgaattcaccgaaagattgcacaaggtcgcaccaaaggtcaaggaaagaatgatgagagaaggttccatgatgatcacctaccaacctatccacgacaagccaaacttcttccgtttggttttgcaaaactccgcattggacaagtccgacatgaactacatcatcgacgagatcgagagattggcagcagacttgtaa

SEQ ID NO: 159 - DNA, 1683 bp, Artificial Sequence
  Artificial DNA Sequence
atgccagccaacggtatgttcgacgttgctttgcaagttatcgacgactccaacgtttcctccggttccgactccgcaggtgtttccgaagacgaagacgtccaattgttctgctccaagggtaacaccatcgtcccaaagccattgaagaagtccatctccaagatcaaggacgaggaattctccaagaccgctaaggcaaacgaaaagagatacgcgtccttgccttccagagaacatcaccagcaattcttgaccgacttcttgtccgaagtcttgaacaacgcagttttcaacgctaccgaaagagcaaacaaggtcttgaactgggttgacccagagcaattgaagagaaccttggacttggaattgaaggacgaaccagactcccacgaaaagttgttggaattgaccagggcaaccatcaagcactccgtcaagaccggtcacccttacttcatgaaccaattgttctcctccgtcgacccatacggtttcgctggtcaaatcttgaccgacgctttgaacccatccgtttacaccttcgaagtctccccagttttcgtcttgatggaagaggttgtcttgaaggagatgagaaccatcgtcggttacccagacggcaccggtgacggcatcttctgtccaggtggttccatggcaaacggttactccatctcctgtgcaagattcaagcacatgccagacgtcaagaccaagggtttgcactccttgccaagattggtcatcttcacctccgaagacgctcactactccgtcaagaagttggcttccttcatgggtatcggttccgacaacgtctacccaatccacaccgacgcaatcggtaagatcagagttgaccacttggaatccgaaatcttgagagctaagtccgaaggtgcagtccctttcatggtctccgcaaccgcaggcactaccgtcatcggtgcattcgaccctttggagcaaatcgcagacttgtgtaagaagtacaacttgtggatgcacgttgacgctgcttggggtggtggcgcattgatgtccaagaagtacagatccttgttgaagggtatcgagagatccgactccgtcacctggaaccctcacaagttgttagccgctccacagcaatgttccaccttcttgaccagacacgaaggtatcttgtccgaatgtcactccaccaacgcaacctacttgttccaaaaggacaagttctacgacacccaatacgacaccggtgacaagcacatccaatgcggtagaagggcagacgtcttgaagttctggttcatgtggcgtgcaaagggcacctccggtttggagcaacacatcgacaaggtcttcgaaaacgccgaacacttcacctcctccatcaagtcccgtgaaggtttcgagatggtcgtcgaaaacccagagtgcaccaacgtctgtttctggtacgtccctccaggtttgagaaacgtcccacgtgactccgctgaattcaccgagagattgcacaaggttgccccaaaggtcaaggaacgtatgatgagagagggttccatgatgatcacctaccaaccaatccacgacaagccaaacttcttcagattggttttgcagaactccgcattggacaagtccgacatgaactacatcatcgacgagatcgaaagattggctgccgacttgtaa

SEQ ID NO: 160 - DNA, 1683 bp, Artificial Sequence
  Artificial DNA Sequence
atgcctgcaaacggtatgttcgacgtcgcattgcaagttatcgacgactccaacgtctcctccggttccgactccgctggtgtctccgaagacgaagacgtccagttgttctgttccaagggtaacaccatcgtccctaagccattgaagaagtccatctccaagatcaaggacgaagaattctccaagaccgcaaaggcaaacgaaaagagatacgcttccttgccatccagagagcatcaccagcaattcttgaccgacttcttgtccgaagttttgaacaacgcagtcttcaacgctaccgagagagccaacaaggtcttgaactgggtcgacccagaacaattgaagagaaccttggacttggaattgaaggacgaaccagactcccacgaaaagttgttggagttgaccagagctaccatcaagcactccgtcaagaccggtcacccttacttcatgaaccaattgttctcctccgtcgacccatacggtttcgcaggccaaatcttgaccgacgctttgaacccttccgtctacaccttcgaagtctccccagttttcgtcttgatggaagaagtcgttttgaaggagatgagaaccatcgttggttacccagacggcaccggtgacggcatcttctgtccaggcggttccatggcaaacggttactccatctcctgtgcacgtttcaagcacatgccagacgtcaagaccaagggtttgcactccttgccaaggttggtcatcttcacctccgaagacgcccactactccgttaagaagttggcatccttcatgggtatcggttccgacaacgtctacccaatccacaccgacgcaatcggtaagatcagggttgaccacttggaatccgaaatcttgagagctaagtccgaaggtgctgtcccattcatggtctccgcaaccgctggcactaccgtcatcggtgccttcgaccctttggaacaaatcgccgacttgtgcaagaagtacaacttgtggatgcacgttgatgctgcgtggggtggtggtgcgttgatgtccaagaagtacagatccttgttgaagggtatcgaacgttccgactccgtcacctggaacccacacaagttgttagcggcaccacaacagtgctccaccttcttgaccagacacgagggtatcttgtccgaatgccactccaccaacgctacctacttgttccagaaggacaagttctacgacacccaatacgacactggcgacaagcacatccagtgtggtagaagagcagacgttttgaagttctggttcatgtggagagctaagggcacctccggtttggaacaacacatcgacaaggtcttcgaaaacgccgaacacttcacctcctccatcaagtccagagaaggtttcgaaatggttgtcgaaaacccagaatgtaccaacgtttgtttctggtacgttccaccaggtttgaggaacgtcccaagagactccgcagagttcaccgaaagattgcacaaggtcgcacctaaggttaaggaaagaatgatgagagagggttccatgatgatcacctaccaacctatccacgacaagccaaacttcttcaggttggtcttgcaaaactccgcgttggacaagtccgacatgaactacatcatcgacgagatcgaaagattggcagcagacttgtaa

SEQ ID NO: 161 - DNA, 1683 bp, Artificial Sequence
  Artificial DNA Sequence'
atgcctgcaaacggtatgttcgacgtcgctttgcaagtcatcgacgactccaacgtctcctccggttccgactccgcaggcgtctccgaagacgaagacgttcaattgttctgttccaagggtaacaccatcgttccaaagccattgaagaagtccatctccaagatcaaggacgaagaattctccaagaccgctaaggcaaacgagaagagatacgcttccttgccatccagagaacatcaccaacaattcttgaccgacttcttgtccgaagttttgaacaacgctgtcttcaacgctaccgaaagagccaacaaggtcttgaactgggtcgacccagaacaattgaagagaaccttggacttggaattgaaggacgagccagactcccacgagaagttgttggaattgaccagagctaccatcaagcactccgtcaagaccggtcacccatacttcatgaaccagttgttctcctccgtcgacccatacggtttcgctggtcaaatcttgaccgacgcattgaacccttccgtttacaccttcgaagtttcccctgtcttcgtcttgatggaagaagtcgtcttgaaggaaatgagaaccatcgtcggttacccagacggcactggcgacggtatcttctgtcctggtggttccatggccaacggttactccatctcctgtgctagattcaagcacatgccagacgttaagaccaagggtttgcactccttgcctagattggtcatcttcacctccgaagacgctcactactccgttaagaagttggcctccttcatgggtatcggttccgacaacgtctacccaatccacaccgacgcaatcggtaagatcagagtcgaccacttggagtccgaaatcttgagagcaaagtccgaaggcgcagtcccattcatggtctccgcgaccgcaggcactaccgtcatcggtgctttcgacccattggaacagatcgcagacttgtgtaagaagtacaacttgtggatgcacgtcgatgccgcttggggtggtggcgctttgatgtccaagaagtacagatccttgttgaagggcatcgagagatccgactccgttacctggaacccacacaagttgttggctgctccacaacaatgttccaccttcttgaccagacacgagggtatcttgtccgaatgtcactccaccaacgctacctacttgttccaaaaggacaagttctacgacacccaatacgacaccggtgacaagcacatccaatgtggtagaagggcagacgtcttgaagttctggttcatgtggagggcaaagggcacctccggtttggagcaacacatcgacaaggtcttcgaaaacgctgaacacttcacctcctccatcaagtccagagaaggcttcgaaatggtcgttgaaaaccctgaatgtaccaacgtctgcttctggtacgtcccaccaggtttgaggaacgtccctagagactccgctgaattcaccgaacgtttgcacaaggtcgcaccaaaggttaaggaaaggatgatgagagaaggttccatgatgatcacctaccaaccaatccacgacaagccaaacttcttcagattggttttgcaaaactccgcattggacaagtccgacatgaactacatcatcgacgaaatcgaaagattggcagcagacttgtaa

SEQ ID NO: 162 - protein, 560 aa, Aedes aegypti
MPANGMFDVALQVIDDSNVSSGSDSAGVSEDEDVQLFCSKGNTIVPKPLKKSISKIKDEEFSKTAKANEKRYASLPSREHHQQFLTDFLSEVLNNAVFNATERANKVLNWVDPEQLKRTLDLELKDEPDSHEKLLELTRATIKHSVKTGHPYFMNQLFSSVDPYGFAGQILTDALNPSVYTFEVSPVFVLMEEVVLKEMRTIVGYPDGTGDGIFCPGGSMANGYSISCARFKHMPDVKTKGLHSLPRLVIFTSEDAHYSVKKLASFMGIGSDNVYPIHTDAIGKIRVDHLESEILRAKSEGAVPFMVSATAGTTVIGAFDPLEQIADLCKKYNLWMHVDAAWGGGALMSKKYRSLLKGIERSDSVTWNPHKLLAAPQQCSTFLTRHEGILSECHSTNATYLFQKDKFYDTQYDTGDKHIQCGRRADVLKFWFMWRAKGTSGLEQHIDKVFENAEHFTSSIKSREGFEMVVENPECTNVCFWYVPPGLRNVPRDSAEFTERLHKVAPKVKERMMREGSMMITYQPIHDKPNFFRLVLQNSALDKSDMNYIIDEIERLAADL

SEQ ID NO: 163 - protein, 563 aa, Culex quinquefasciatus
MPTNGMFDVALQVIEDANLSSGSDSAGVSEDEDVQLFCTTGNVVSSKPLKKPSLKPVTTVKDEDQNKMKTNAKRYASLPNREQHQRFLTDFLSEVLNNAIFNATDRSNKVLNWVDPEELKRSIDLSLKAEPDSDEKLLELARATIDHSVKTGHPYFMNQLFSSVDVYGFAGQCLTDALNPSVYTFEVSPVFVLMEEVVLKEMRTIVGFPGGVGDGIFCPGGSMANGYAISCARFKHMPDVKTKGLHSLPRLVIFTSEDAHYSIKKLASFMGIGSDNVYPIRTDAVGKIQPDHLEAEILRAKSEGALPFMVSATAGTTVIGAFDPLEQIADLCQKYNLWMHVDAAWGGGALMSKKYRTLLKGVERADSVTWNPHKLLAAPQQCSTFLTRHEGILSGCHSTNATYLFQKDKFYDTQYDTGDKHIQCGRRADVLKFWFMWRAKGTSGFEQHIDKVFENAEYFTNSIKARPGFEMVIENPECTNVCFWYVPPGLRQVPRDSAEFGERLHKVAPKVKERMMREGSMMITYQPIHDKPNFFRLVLQNSGLDKSDMNYIIDEIERLASDL

SEQ ID NO: 164 - protein, 567 aa, Anopheles gambiae
MPANGVCSVGLEVIEDNATYASGSDSAGVSEDEDVQQLFVSGADRVTSVLPKKSDIRKASQVDEQAAAAAAAAVSEKRYASLPNREQHQQFLTQFLTEVLNSAVFNATDRANKVLNWVDPEELQRTLDLALKDEPDTHEKLLELTRATIRHSVKTGHPYFMNQLFSSVDPYGFAGQVLTDALNPSVYTYEVSPVFVLMEEVVLREMRTIVGYPDGEGDGIFAPGGSMANGYAISCARHKFMPDIKTKGLHALPRLVIFTSEDAHYSVKKLASFMGIGSDNVYAIKTDNVGKIRVEHLESEILRAKSEGALPFMVSATAGTTVIGAFDPLEQIADLCAKYNLWMHVDAAWGGGALMSKKYRTLLKGIERSDSVTWNPHKLLAAPQQCSTLLTRHRNILAEAHSTNATYLFQKDKFYDTRYDTGDKHIQCGRRADVLKFWFMWRAKGTAGFEAHIDKVFENAEHFTSSIKARPGFEMVIEQPECTNVCFWYVPPGLRGVPRDSAEYRDRLHKVAPKVKERMMKDGSMMITYQPIHDKPNFFRLVLQNSSLDKSDMNYIIDEIERLGKDL

SEQ ID NO: 165 - protein, 540 aa, Tribolium castaneum
MPATGEDQDLVQDLIEEPATFSDAVLSSDEELFHQKCPKPAPIYSPVSKPVSFESLPNRRLHEEFLRSSVDVLLQEAVFEGTNRKNRVLQWREPEELRRLMDFGVRSAPSTHEELLEVLKKVVTYSVKTGHPYFVNQLFSAVDPYGLVAQWATDALNPSVYTYEVSPVFVLMEEVVLREMRAIVGFEGGKGDGIFCPGGSIANGYAISCARYRFMPDIKKKGLHSLPRLVLFTSEDAHYSIKKLASFQGIGTDNVYLIRTDARGRMDVSHLVEEIERSLREGAAPFMVSATAGTTVIGAFDPIEKIADVCQKYKLWLHVDAAWGGGALVSAKHRHLLKGIERADSVTWNPHKLLTAPQQCSTLLLRHEGVLAEAHSTNAAYLFQKDKFYDTKYDTGDKHIQCGRRADVLKFWFMWKAKGTSGLEKHVDKVFENARFFTDCIKNREGFEMVIAEPEYTNICFWYVPKSLRGRKDEADYKDKLHKVAPRIKERMMKEGSMMVTYQAQKGHPNFFRIVFQNSGLDKADMVHLVEEIERLGSDL

SEQ ID NO: 166 - protein, 600 aa, Attagenus smirnovi
  misc_feature (36)..(36): Xaa can be any naturally occurring amino acid
MVTIWPTSPQGKVIAARPARDPSTSYNGGFAAQYRXFVIQSCKQLNFSSRGITNHARQRRSEKYNLEEDVTDEATSNSDHSPSEDDDLYVRHTNGFNIKPSKPIIEPRKFATFPSVPDKEHHEDFIKACVDILLKEAVFDGTNRKNRVLEWHSPEELKKLFDFNLRKSGSSHEELTRLIKDTIHYSVKTGHPYFVNQLFSSVDLYGLVGQWLTDALNPSVYTYEVSPVFTLMEETVLREMRTIVGFEDGKGDGIFCPGGSMANGYAISCARYKFKPDIKDTGLHGLPRLVLFTSEDAHYSIKKMASLLGIGSNNVYLIKTDELGRMSVPHLVEQIERVHKEGGAPFMVSATAGTTVLGAFDPIQELADVCERYNLWLHVDAAWGGGALISQRHRHLLTGINRADSVTWNPHKLLTAPQQCSTLLLRHEGILAGAHSANAAYLFQKDKFYDTRYDTGDKHVQCGRRADVLKFWFMWKAKGTIGFEQHIDKVFDNAKFFSDNIRHRPGFRMVLEDPECTNICFWYVPPSMRGCEDQQDFNERLHKVAPKIKERMMKEGSMMVTYQPQKSLPNFFRIVFQNSGLERSDMLHLIKEFERLGHDL

SEQ ID NO: 167 - protein, 537 aa, Acyrthosiphon pisum
MPIVMPAATVPTDYATARPVELMVTASTLDETPCGKGPMMESLSAAVCGYKSAPNAADHEAFVRDAVRLMLEQAVFRGTDRRRPVLNWKSPEELQAAFDFALDRSPTTHGHLLNLIEDTIEHSVKTGHPYFINQLFSSVDPYGLIGQWLTDALNPSVYTFEVAPVMTIMEETVLTEMRKFLGYPDGKGDGIFCPGGSIANGYAINCARFSAFPEVKTRGMHGLPRLVVYTSADAHYSIKKLCAFEGIGSDNLYLINTDAKGKMDVSHLRQQIQRTLEEKAVPIMVSATAGTTVLGAFDPIAEIADVCHEYGIWLHVDAAWGGGALVSKKHKHLLTGIDRADSVTWNPHKMLTAPQQCSTFLTKHERVLTESNSSCAQYLFQKDKFYDTTYDTGDKHIQCGRRADVFKFWFMWKAKGTDGLEAHVDENFDNAKYFTEMIRNRAGFKLVLEEPEYTNITFWYIPPSLRGRQNEPDFKNKLHKVAPRIKERMMKEGTMMITYQPSDDLPNFFRLVLQNSSLDQNDMDYFVNEIERLGSDL

SEQ ID NO: 168 - protein, 576 aa, Drosophila sechellia
MLASENFPTHHFKESIFKPYSTTSGDDLASVTPLTATAALVASTPSPADSTSAVAFEQASKMLATAANNNNNNNNNNITSTKDDLSSFVASHPAAEFEGFIRACVDEIIKLAVFQGTNRSSKVVEWHEPAELRQLFDFQLREQGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENGWQPLMVSATAGTTVLGAFDDLAGISELCKKYNMWMHVDAAWGGGALMSKKYRHLLNGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 169 - protein, 575 aa, Drosophila melanogaster
MLASENFPTHHFKESIFKPYSTTSGDDLASVSPLTATAALVASTSSPADSTSTVAFEQASKMLANAANNNNNNNNNITSTKDDLSSFVASHPAAEFEGFIRACVDEIIKLAVFQGTNRSSKVVEWHEPAELRQLFDFQLREQGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSDHVRKIATNEVGKMRLSDLEKQVKLCLENGWQPLMVSATAGTTVLGAFDDLAGISEVCKKYNMWMHVDAAWGGGALMSKKYRHLLNGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 170 - protein, 508 aa, Danaus plexippus
MRVDSKIIVKKETQDENLYQSLAERSKHEEFLRKAVDLLVERVVFGRSTRSSKVVEWAAPDEIKKAIDLKPRLGPASHDELLAFMANVARYSVNTGHPYFVNQLFSSVDPYGLVGQWLTDALNPSVYTFEVAPVFTLMEEEVLREMRKIVGWPEGEGDGIFCPGGSIANGYAISCARHHFYPEVKYKGVHAVPKLVLFTSELAHYSTKKMAAFMGIGSDNCVNIKTDDVGKMNIVDLEMKIKIAIDNKCTPFMVTATSGTTVFGAFDPLVAISDLCKKYNLWLHVDAAWGGGALMSKKHRHLLNGIELADSVTWNPHKLLAAPQQCSTFLTRHKKVLSEGHSSNAKYLFQKDKFYDTSYDTGDKHIQCGRRADVLKFWFMWKAKGTEGFEKHVDKLFDNAKYFLDHIKQREGFQLVIAEPQCTNIMFWYIPKCLRGCENDADYYERLHKVAPKIKERMIKEGSMMVTYQPQGDLVNFFRIVFQNSALDHKDMVYFANEFERLGSDMIV

SEQ ID NO: 171 - protein, 570 aa, Drosophila yakuba
MLASENFPTHHFKESIFKPYSTSGDDLASATPLTAAAALVATTSSPADSSSAVAFETASKMLATNNNNNNNITSSKDDLSSFVASHPAAEFEGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENNWQPLMVSATAGTTVLGAFDDLAGISELCKKYNMWMHVDAAWGGGALMSKKYRHLLSGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 172 - protein, 572 aa, Drosophila erecta
MLASENFPTHHFKESIFKPYSTSGDDLASVTPLTAAAALVASTSSPADSSSAVAFETASKMLTTTNSNNNNNNTTSAKDDLSSFVASHPAAEFEGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENDWQPLMVSATAGTTVLGAFDDLAGISDVCKKYNMWMHVDAAWGGGALMSKKYRHLLSGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 173 - protein, 508 aa, Papilio xuthus
MPADSNLIVAGEAIKESLFQSLPERSKHEEFIRRAVDLLVERVVFGRSQRSAKVVEWAAPDEIKSVIDLKPREGPVSHDELLAIMADVARYSVNTGHPYFVNQLFSTVDPYGLIGQWLTDALNPSVYTYEVAPVFTLMEEEVLREMRAIVGWKDGDGDGIFCPGGSISNGYAISCARHHFYPDVKSKGVYAVPKLVLFTSELAHYSTKKMACFMGIGSDNCIMIKTDELGKMDVGDLEIKISEAINSGSTPFMVTATAGTTVFGAFDPLIPISDLCKKYNLWLHVDAAWGGGALMSKKHRHLLKGIELADSVTWNPHKLLAAPQQCSTFLVRHKNVLKEGHSSNAKYLFQKDKFYDTSYDTGDKHIQCGRRADVLKFWFMWKAKGSDGFEKHIDKLFDNAKYFLDHIKQRAGFKLVLENPECTNIMFWYVPNCLRGCENDPNYRERLHKVAPKIKERMIKEGSMMVTYQPQGNLVNFFRIVFQNSALDHKDMVYFANEFERLGSDIIV

SEQ ID NO: 174 - protein, 589 aa, Drosophila persimilis
MLASETFPAHRFKESIFKPYSTSGSASVDDLASVNKTLTSAATTSSSPDTHAAVDIAPTASSVEFETARKMLTNNSSSSSNNSNNNNNNNNNDAKDDISGFVASHPAAPFEGFIRACVDEIIKLAVFQGTNRSTKVVEWHEPAELRQLFDFQLRDKGEPQEKLRELLRETIRFSVKTGHPYFINQLYSGVDPYALVGQWLTDALNPSVYTYEVAPLFTLMEEQVLAEMRRIVGFPNGGKGDGIFCPGGSIANGYAISCARYTYAPESKKNGLFNAKPLIIFTSEDAHYSVEKLAMFMGFGSEHVVKIATNEVGKMRLSDLEDQVRRCLDNGWQPLMVSATAGTTVLGAFDDLTGIGDLCRKYNMWMHVDAAWGGGALMSKKYRHLLNGIERADSVTWNPHKLLAASQQCSTFLTRHQLVLGQCHSTNAAYLFQKDKFYDTSYDTGDKHIQCGRRADVFKFWFMWKAKGNLGLESHVEKVFRMAEFFTAKVRERPGFELVLESPECTNISFWYVPPSLRTMERDREFYDKLHKVAPKVKERMIKKGSMMITYQPLRQLPNFFRLVLQNSCLEESDMIYFLDEIESLAKNL

SEQ ID NO: 175 - protein, 511 aa, Bombyx mori
MPADSDLIVAEREDLGIDRTLYKSLSERSKHEDFIRRAVDLLVERVVFGRSLRTSKVVEWAVPSEIKKAIDLKPRDGPISHDELLGLMADVARYSVNTAHPYFVNQLYSSVDPYGLVGQWLTDALNPSVYTYEVAPVFTLMEEEVLKEMRVLVGWKDGEGDGIFCPGGSIANGYAISCARFHFYPEIKTKGVYAVPKLTLYTSELAHYSTKKLAAFMGIGDENCVLIKTDKYGKIDVEDLEAKIVEGIEEGAAPFLVTATAGTTVFGAFDPLVPIAALCKKYNLWLHVDAAWGGGALMSKKHRHLLNGIELADSVTWNPHKLLAAPQQCSTFLIRHKNVLKEGHSCNAKYLFQKDKFYDTSYDTGDKHIQCGRRADVLKFWFMWKAKGSDGFENHIDTLFDNARFFLEQIRNREGFELVIEKPECTNIMFWYVPRCLRGCENESDYRERLHKVAPKIKELMIKEGSMMVTYQPQGDLVNFFRIVFQNSALDHKDMIYFVNEFERLGRDILV

SEQ ID NO: 176 - protein, 578 aa, Drosophila ananassae
MLASKNYPTHHFKESIFKPYSTSGDDLASVNTLTASAASAAMVATTSSSADTVAVDFENARRMLATNGGIASNGNNNNNVLDSKDSLSGFVASHPAAQFDGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYKYTPESKKNGLFNAKPLIIFTSEDAHYSVEKLAMFMGFGSEHVRKIATNEVGKMRVEDLENQIKMCLENNCQPLMVSATAGTTVLGAFDDLVGISELCKKYNMWMHVDAAWGGGALMSKKYRHLLNGIERADSVTWNPHKLLAASQQCSTFLTPHQQILAQCHSTNATYLFQKDKFYDTSFDTGDKHIQCGRRADVFKFWFMWKAKGSQGLEAHVEKVFRMAEFFTAKVRERPGFELVLDQPECTNISFWYVPPSLRQMERNREFYDRLHKVAPKVKEGMIKKGSMMITYQPLRQLPNFFRLVLQNSCLEESDMLYFLNEIESLAQNL

SEQ ID NO: 177 - protein, 580 aa, Drosophila mojavensis
MLASENFQAHLYNRSSIYKPYNEELASMAKQLTTATADAAGIDAAQAAVDYGSPSKQMLGSNNGSSSGSSNKTSSANSNNNNNNVANGLSSFVASHPSAEFEGFIRACVDEIIQLAVLQGTNRSSKVVEWHEPAELRKLFDFELRDQPDSPDKLRQLLRETIRFSVKTGHPYFINQLYSGVDPYALIGQWLTDALNPSVYTYEVAPVFTLMEEQVLGEMRRIVGFPNNGQGDGIFCPGGSIANGYAISCARYQYAPESKKNGLFNAKPLVIFTSEDAHYSVEKLAMFMGFGSEHVRKIATNELGKMRLSDLEQQIQFCLDNNWQPLMVSATAGTTVLGAFDDLLGISELCRKHNMWMHVDAAWGGGALMSKKYRQLLNGIERADSVTWNPHKLLSASQQCSTFLTRHTQILGQCHSTNAAYLFQKDKFYDTSFDTGDKHIQCGRRADVFKFWFMWKAKGTKGFEAHVEQVFEMSEYFTNKLRERPGFELVLDKPECTNITFWYVPPSLRQMERNQEFYDKLHKVAPKIKEAMIKKGSMMITYQPLRKLPNFFRLVLQNSCLDESDMLYFLNEIETLGQKL

SEQ ID NO: 178 - protein, 588 aa, Drosophila grimshawi
MLASKTFPTHHFKKSIYTTYNGASAPTNVEDLANVAKTLTTTTSSSSDSTVVEANTSPVEFSTPSKMLSSTSTTTTTTTNNNNNNNSNNNNNIVNGLSSFVASHPAAEFEGFIRACVDEIIHLAVFQGTDRASKVVEWHEPAELRKLFDFELREKGESQEKLRQLMRETIRYSVKTGHPYFINQLYSGVDPYALVGQWLTDALNPSVYTYEVAPVFTLMEEQVLAEMRRIVGFPDNGHGDGIFCPGGSIANGYAISCARYNYAPESKKNGLFNAKPLIIFTSEDAHYSVEKLAMFMGFGSENVRKIATNEVGKMRLSDLEEQIQLCLDNNWQPLMVSATAGTTVLGAFDDLVGISELCRKHNMWMHVDAAWGGGALMSKKYRHLLNGIERADSVTWNPHKLLSASQQCSTFLTRHAQILGQCHSTNAAYLFQKDKFYDTSFDTGDKHIQCGRRADVFKFWFMWKAKGSKGFEAHVEQVFEMSEFFTAKLRERPGFELVLDHPECTNITFWYVPPSLRHMEHNQEFYDKLHKVAPKIKEAMIKKGSMMITYQPLRKLPNFFRLVLQNSCLEESDMLYFINEIESLGQNL

SEQ ID NO: 179 - protein, 461 aa, Biston betularia
SQRSAKVVEWAAPEEIKKAIDLKPRDGPASHDQLLGLMADVARYSVNTGHPYFVNQLFSSVDPYGLIGQWLTDALNPSVYTFEVAPVFTLMEEEVLKEMRSLVGWKNGDGDGIFCPGGSIANGYAISCARFYYYPDIKTKGVYAVPRLVLFTSELAHYSTKKMAAFMGIGSDNCILVKADKLGKMDAEDLEVKINEALDDGATPFLVTATAGTTVYGAFDPLAQISSLCKKYNLWLHVDAAWGGGALMSKKHRHLLTGIELADSVTWNPHKLLAAPQQCSTFLIKHKNVLKDGHSSNAKYLFQKDKFYDTSYDTGDKHIQCGRRADVLKFWFMWKAKGSEGFEQHIDTLFDNAKHFVYLIRNREGYRLVIEEPECTNIMFWYIPKCLRGCENEPDYKERLNKVAPKIKERMIKEGSMMVTYQPQGDLANFFRIVFQNSALDHKDMVYFANEFERLGRDIVV

SEQ ID NO: 180 - protein, 583 aa, Drosophila willistoni
MLASENFPTHHFKESIFKPYNATTSAANAAAAATVEDLANVAKTLTSKSTTSSSVASDAAATVSLMGAVDIETARKMLANNNVNINNNNNNNINNNNSKDTAEFESFLRGCIDEIIKLAVVEGTNRSSKVVEWHEPSELRQIFDFQLREKGESQDKLRELLRETIRFSVKTGHPYFINQLYSGVDPYALVGQWLTDSLNPSVYTYEVAPVFTLMEEEVLAEMRRIVGFPDNGLGDGIFCPGGSIANGYAISCARYKYAPESKKNGLFSGKPLIIFTSEDAHYSVEKLAMFMGFGSEHVRKIATNEVGKMRLSDLEQQIQLCLDNNWQPLMVSATAGTTVLGAFDDLVGISELCRKHNMWMHVDAAWGGGALMSKKYRHLLNGIERADSVTWNPHKLLAASQQCSTFLTRHQQILGQCHSTNATYLFQKDKFYDTSYDTGDKHIQCGRRADVFKFWFMWKAKGSEGLRAHVEQVFRMSEYFTQQVRERPGFELVLESPECTNISFWYIPPSLRHMERNQEFYDKLHKVAPKIKEGMIKKGSMMITYQPLRRLPNFFRLVLQNSCLEESDMLYFLNEIESLGHQL

SEQ ID NO: 181 - protein, 548 aa, Apis mellifera
MPANEETLSMTSDQIRNNLLGKACDDSMQNNFDCESSGDDEEDYQNDCSRSIVKENFKEVCNYKSLPVREIHKKFMKSFVNLLLEEAVFEGTLRRNKVVEWIEPTTLHSIIDLKLSDQGCSYETLLTLAHNVIKYSVKTGHPRFINQLYSSVDPYGLLGQWLTDALNPSVYTYEVSPVFSLMEEEILREMRKIVGWKDGRSEGIFCPGGSIANGYAINLARYYKFPQSKELGLFNTGRLIIFTSRDAHYSVKKLSAFLGIGTENVYEVKTDDKGKMCITDLKIQIKKALEEDAIPLMVSATAGTTVLGAFDPLKNIAAICKNYNLWFHVDAAWGGGALMSKKYKYLLDGIELADSVTWNPHKLLAAPQQCSTLLLRHEGLLQDAHGSKASYLFQPDKFYDTSFDSGDKHIQCGRRADVLKFWFMWKAKGTRGLEKHVDRVFKLARYFTNYIKHREGFKLILEPECTNVCFWYVPPSKRQLQNEELLKALQKIGPAVKERMMKKGSMLITYQPLRELPNFFRLVLQNSGLTETDMRFFAEEIERLAIDL

SEQ ID NO: 182 - protein, 586 aa, Drosophila virilis
MLASETFPTHHFKNSIYKPYNGASSAPDVEDLASMAKTLTTTTLSSSDAAVIDVVKTTVEYGNPNKMLNSSVSSSSNSNNKNNNIKNTNGNVNGLASFVASHPAAEFEGFIRACVDEIIKLAVFQGTNRSSKVVEWHEPAELRKLFDFELREKGESPDKLRQLLRETIRFSVKTGHPYFINQLYSGVDPYALVGQWLTDALNPSVYTYEVAPVFTLMEEQVLAEMRRIVGFPNNGHGDGIFCPGGSIANGYAISCARYKYAPESKKNGLFNAKPLIIFTSEDAHYSVEKLAMFMGFGSEHVRKIATNELGKMRLSDLEDQIQLCLDNNWQPLMVSATAGTTVLGAFDDLVGISELCRKHNMWMHVDAAWGGGALMSKKYRQLLNGIERADSVTWNPHKLLSASQQCSTFLTPHAQILGQCHSTNAAYLFQKDKFYDTSFDTGDKHIQCGRRADVFKFWFMWKAKGSKGFEAHVEQVFEMSEYFTAKLRERPGFELVLEKPECTNITFWYVPPSLRQMERNQEFFDKLHKVAPKIKEAMIKKGSMMITYQPLRKLPNFFRLVLQNSCLEESDMLYFLNEIEDLGQNL

SEQ ID NO: 183 - protein, 547 aa, Nasonia vitripennis
MPAHEETQLQEGSAIEALERPRSADSEKHSRLDYEREEEAHQIGEDSDEGYAMDNFNEEGFFCSLPGRESHEKFIRDAVEMILREAVFKGTSRKNRVVEWIEPATLPSKIDLPPRKTGESHEALLRLLDSVIRYSVKTGHPHFVNQLYSSVDPYGLVGQWLTDALNPSVYTYEVSPVFSLMEEAVLKEMRAIVGWQNGEGDGIFCPGGSMANGYAINLARHWMFPIVKEQGLTAVPRLVVFTSEDAHYSVKKLAAFLGIGIANVYSVKVDESGKMCVSDLRAQIDRAIQEGARPLMVSATAGTTVLGAFDPLRSIAELCREHNMWFHVDAAWGGGALVSPKHRHLLDGVELADSVTWNPHKLLAAPQQCSTLLTRHKGLLQSAHGCKATYLFQQDKFYDTSYDFGDKHVQCGRRADVLKFWLMWKAKGTDGLEKHVDRVFQLSRYFVGIIRNRPGWQLLFEPECTNVCFRYVPPSKRHLNGQDLFQALHKVAPLVKERMVKTGSMLITYQPIREQANFFRLVLQNSGLTEADMHFFVEEIERLSEDL

SEQ ID NO: 184 - protein, 508 aa, Bicyclus anynana
MPADSNIIVAVEEKKEDGLFQSLTERSKHEDFIRRAVDLLVERVVFGRASRTSKVVEWSAPEDIKQAIDLKVRDGPASHEELLAFMADVARYSVNTAHPYFVNQLFSSVDPYGLIGQWLTDALNPSVYTFEVAPVFTLMEEEVLREMRSIVGWADGEGDGIFCPGGSIANGYAISCARSYFYPEIKNKGVYAVPKLVIFTSELAHYSTKKMAVFMGIGSDNCILVKADENGRMDVNDFERKINEAIEAGATPFLVTSTSGTTVYGAFDPIVPISNICKKYNLWLHVDAAWGGGALMSRKHRNLLNGIEADSVTWNPHKLLAAPQQCSTFLLKHKNVLKEAHSSNAQYLFQKDKFYDTSYDTGDKHIQCGRRADVLKFWFMWKAKGSEGFEKHVEKLFDNANYFLEHIRQREGFRLVIPKPECTNIMFWYIPKCLRSCENEPNYYERLHKVAPKIKERMIKEGSMMVTYQPQGNLVNFFRIVFQNSALDHKDMIYFANEFERLGSDIVV

SEQ ID NO: 185 - protein, 543 aa, Harpegnathos saltator
MPANEDTSNESLERIEPGRISPSLSQRKMSGGLQNLASSLLPGATVDDDLESSRVEERNFRSIPRRDIHEKLFRDFFELVLQQAVFQSTSGKERVVEWMNPSDLRSVVDFSLPAEGVSHEELLALTRNVIKYSVKTGHPHFVNQLFSSLDPYGLLGQWLTDALNPSVYTYEVSPVFSLMEEDVLREMRRIIGWKGGEGLFCPGGSMANGYAINLARHHRYPNMKQTGLSQMPRLVIFTSEDAHYSVKKLAAFLGIGYDNVYSVKVDSRGKMLVSDLEAQIARATREGAVPLMVSSTAGTTVLGAFDPLKDIAEVCRKHRLWFHVDAAWGGGALVSRTYRRLLDGVELADSITWNPHKLLAAPQQCSTLLLRHEGLLQSAHGCGASYLFQNDKFYDSSYDCGDRHVQCGRRADVVKFWYMWKAKGTRGLEEHVDHVFALSRYFADLVRTRDGWHLLAEPECTNVCFRYIPPSMRDLAGRQLDQAIHKVAPMIKERMVRAGTMLMTYQPLRGTPNFFRLVLQNSGLSEIDMQFFVEEIERLAADL

SEQ ID NO: 186 - protein, 548 aa, Acromyrmex echinatior
MPANEDTSNDETSLRMKHERAGPSMESSWRKMSEEHPRANPSPIPNLPGLVNGIEERQGIEKWDFRSMPRRDAHEKLFRDFFELVLQRAVFQPTSGKDRVVEWVDPYDLRSVVDLSLPAEGVSHEKLLTLTRDIIKYSVKTSHPHFVNQLFSSLDPYGLLGQWLTDALNPSVYTYEVSPVFSLMEEDVLREMRAIISWQEGEGLFCPGGSMANGYAINLARHHRYPNLKQSGLSQMPRLVVFTSEDAHYSVKKLAAFLGIGYDNVYLVKVDSRGKMMVSDLEAQIARAVEEGAAPLMVSATAGTTVIGAFDPLREIAEVCRKHELWFHVDAAWGGGALISETYRGLLDGIQFADSVTWNPHKLLAAPQQCSTLLLRHEGLLQAAHGCGASYLFQNDKFYDASFDCGDRHVQCGRRADVVKFWYMWKAKGTRGLEAHVDRLFALSRHFTDLIRTRDGWHLLVEPECINVCFRYIPPSKRHLTGQELEQALHKIAPIIKERMVRAGTMLITYQTLRNMPNFFRLVLQNSGLTEADMKFFVEEIERLAMDL

SEQ ID NO: 187 - protein, 544 aa, Camponotus floridanus
MPANEDTSANDFAFKRIKPERANPAESQPKMSRKDDSSTNLILSNFTASVEERKEAEKGDFRSIPCRSVHEKLFRDFFELMLQRAVFQSTSGEERVVEWIDPNNLRSVVDLSLPTEGVSHEELLTLTRDIIKYSVKTGHPHFVNQLFSSLDPYGLLGQWLTDALNPSVYTYEVSPVFSLMEEDVLREMRAIIGWQGGEGLFCPGGSMANGYAINLARHHRYPNLKQSGLSQMPRLVVFTSEDAHYSVKKLAAFLGIGYDNVYLIKVDSRGKMVVTDLEAQIVRAINEGAVPLMVSATAGTTVMGTFDPLKKIAEVCRKHGLWFHVDAAWGGGALVSRTYRGLLDGIQLADSITWNPHKLLAAPQQCSTLLLRHEGLLQEAHGCGASYLFQNDKFYDATFDYGDRHVQCGRRADVVKFWYMWKAKGTRGLEAHVDCVFALSRYFADLIRTRDGWRLLAEPECTNVCFRYIPLSKRHLTGRELDQALHKIAPMIKERMMRAGTMLITYQTLRDMPNFFRLVLQNSGLTEADMKFFVEEIERLAVDL

SEQ ID NO: 188 - protein, 532 aa, Pediculus humanus
MFPVISTQKQSFGIINLSLLEDNNFLIKTNSVVDKSDKEDEKLNQKHWSLPLEKYHYDFIVKCVGIIMKEAVFDGTNRNSKVVQWQDPEKLKKSFDFSLNKYSETEGKLLHLISTIIKFSVKTGHPYFVNQLFSGVDPYGLIGQWLTDALNPSVYTYEVSPVFSIMEEVVLEEMRKFIGFPNGKGDGTFCPGGSISNGFGISCARYHLFPQVKKLGIYGIGLRLVLFTSRDAHYSIVKLATFMGLGSDNVISIKTDESGKMKPEELEKAILKVLQEGGTPFMVSATSGTTVLGAFDPLDSIADICEKYKLWFHVDAAWGGGCLMSSIHKKKLQGIHRTDSVTWNPHKLLGVPQQCSAFLTKHKNLLKNVHCAKATYLFQKDKFYDVKYDTGDKHIQCGRRADVLKFWFMWKAKGSSGFEKHINKIFETALYFKKSIENKPDFQLVLSEPECTNICFWYIPPRLQNSKYNNDDLNKVAPRMKEKMMKDGSMMITYQPLRHLPNFFRLVIVNSGLDTHDMDRLITIIQNAGASI

SEQ ID NO: 189 - protein, 549 aa, Atta cephalotes
MPANEDTSNDETSLRMKHERADSSAESSWRKMSEERPRANSSSLTLNLPGLVNGTEERQRAEKRDFRSMPRRDAHEKLFRDFFELVLQRAVFQSTSGKDRVVEWVDPYDLRSVVDLSLPAEGVSHEELLTLTRDIIKYSVKTGHPHFVNQLFSSLDPYGLLGQWLTDALNPSVYTYEVSPVFSLMEEDVLREMRAIIGWQGGEGLFCPGGSMANGYAINLARHHRYPNLKQSGLSQMPRLVVFTSEDAHYSVKKLAAFLGIGYDNVYLVKVDSRGKMMVSDLETQIAQAVKEGAAPLMVSATAGTTVIGAFDPLREIAEVCKKHGLWFHVDAAWGGGALVSGTYRDLLDGIQFADSVTWNPHKLLAAPQQCSTLLLRHEGLLQAAHGCGASYLFQNDKFYDASFDCGDRHVQCGRRADVIKFWYMWKAKGMRGFEAHVDHLFALSRHFTDLIRIRDGWHLLVEPECINVCFRYIPPSKRHLAGQELEQALHKIAPIIKERMVRAGTMLITYQTLRNMPNFFRLVLQNSGLTEVDMKFFVEEIERLAMDL

SEQ ID NO: 190 - protein, 335 aa, Meligethes aeneus
KEMRQIVGFKNGDGDGIFCPGGSMANGYAISCARYKFMPEIKQKGLHALPRLVLFTSRDAHYSIKKLSSFLGIGTDNVYAINTDEKGKMDMKHLEEEVERSIKEGGAPFMVSATSGTTVIGAFDPLEKIHEICQKYGMWMHVDAAWGGGALMSKKHRYLLKGIEKADSVTWNPHKLLTAPQQCSTLLLKQDGILSAMNSANATYLFQKDKFYDTKYDIGDKHIQCGRRPDVIKFWFMWKAKGTSGFEQHIDKVFENAKFFTDTIREREGFEMVIPEPECTNICFWYVPPSLRNRKSDPDYQDKLHKVAPKIKEKMMREGTMMVTYQPLRETPNFF

SEQ ID NO: 191 - protein, 401 aa, Solenopsis invicta
STSGEDRVVEWVDPYELRSVVDLSLPAEGVSHEELLKLTRDVIKYSVKTGHPHFVNQLFSSLDPYGLLGQWLTDALNPSVYTYEVSPVFSLMEEDVLREMRSIIGWHNGEGLFCPGGSMANGYAINLARHHRYPHLKQTGLSQMPRLVVFTSEDAHYSVKKLAAFLGIGYDNVYLAKVDSRGKMVVSDLEAQIARAIEEGAAPLMVSATAGTTVIGAFDPLKDIAEVCKKYGLWFHVDAAWGGGALVSAAYRGLLDGLHLADSVTWNPHKLLAAPQQCSTLLLRHKGLLQAAHGCGASYLFQNDKFYDASFDCGDRHVQCGRRADVVKFWYMWKAKGTRGLEAHVDRVFALSRYFADLIRAREGWHLLVEPECTNVCFRYVPPSKRHLAGQELDQVLHKVS

SEQ ID NO: 192 - protein, 497 aa, Daphnia pulex
MENPALIGWFQTEPSQEQHEQFMRKVMDIVLKEAVFEGTSRNNLVIEWMEPESLLTLLGKELPKNPQSDETLVELIKNVVRYSVKTGHPHFINQLFSSLDPYGLVAQWVTDSLNPSVYTYEVAPVFTLLEHQILREMRRWVGFPDGSGDGVFCPGGSMANIYGIQCARHRAMPSLKETGTFGSPRLVVLTSKDAHYSVKKACFLLGIGVSNLYLVDVDTSGRMDLVHLRQEVQRALNENARPFMVSATAGTTVLGATDPLDGIADICQEFGMWMHVDAAWGGGALMSTKHRHILKGIERADSVTWNPHKLLGVPQQCSTFLTRHADLLLEANSASASYLFQKDKFYDPKWDVGDKYLQCGRRADVLKFWLMWQAKGSLGLEKHVDTLFENVAYFTSFIRNRKGFQLVLEEPPFVNVCFWYIPPSLQGAQHDEDYEEKLHKIAPKIKERMIKKGSMMITYQPLRNLPNFFRLVLQSSAVTIDDMEFFAEEIERLGCDL

SEQ ID NO: 193 - protein, 581 aa, Lottia gigantea
METKRFDNMSINDEATKEQFNELKQRLLEGKSLKSKQVSKVMIDVDSESEDSALSLQDSSANTDESDPDESNVETCTTQLQHSQRVNSRRKSTKAKFLTIPQVHHDDFLSDTFDLIMKEIVQKAGDRSQKVVEWKAPEELRELMDLDPTAVGETHEKLLMRLQDIIKYSVKTGHPRFVNQLFSSLDPYGLAGQIVTDALNTSQYTYETAPVFTLMEETVLKTMRTCIGYTEGNGIFCPGGSLSNIMAVNCARHFMFPQTKKTGMFGLPPLVIYTSELAHYSIKKAGYLLGFGDDNVKLVKTDELGKIIPEDLERQIQETIDEGCTPFMIVATAGTTVFGAFDPIDKMADVAQKYGLWYHVDGAWGGGVLMSKKHRDMMKGVDRADSVTWNPHKLLGVPQQCSCFLTKHVNILQQCHRADAKYLFQKDKFYDTSYDTGDKTFQCGRKVDVLKFWLMWKAKGSEGFEQHIDKLFDNTRYIVEKLKQREGFRMVVNEPDCTNVCFWYVPPSLRNMPEDEEFWNRLHTVAPKVKEGMIRDGTMMITYQPQKDLVNFFRLVLQNSATTYEDMDFFIDEIERLGKFL

SEQ ID NO: 194 - protein, 538 aa, Branchiostoma floridae
MSNILTSLEDSSFSCSCAKEMINGGIDGHLNDCSVRNLKSSLNDDTANVKAPKKDPLPKDEEDFLKAVFQVILEDGVRKGRDITQKVVDFHQPDELRTLLDLEIRDTPEDHQALIKHMKDTVKYSVRTSHPRFFNQLFSGQNTYALAGQWLTETLNTSQYTFEVAPVFTIMENVVLHKMRDIVGYSGGDGIFCPGGSISNLYALNVARYRYMPDIKKTGLFGLPRLVVFTSKQSHYSIKKAASVLGIGTNNVVLVDCDERGKMIASDLEAQILRVKAEGAVPFFVNCTSGTTVLGAYDPLDEVSDICEKHGLWMHVDAAWGGGVMMSPKYRASRMRGVERSDSITWNPHKMMGAGQQCSAFLLKHENLLQHCHEAKAKYLFQQDKFYDVSYDTGDKSIQCGRKVDVFKLWLMWKAKGSQGFHQDMDAIFDKTRYLVEKVKAREGFKMVLDEPECSNVCFWYIPPSLRGKEDEADYKDKLHQVAPRIKERMVLSGTMLVGYQPLGNKPNFFRQVFSSPSVTEEDLDFLLDEIERLGEDL

SEQ ID NO: 195 - protein, 555 aa, Crassostrea gigas
MASCMTESFKVHSCAHKRIHDKNDFEVEPTEKQRITMLSDKPVRKSNKENSMCNVTIKTKESHSENHKKHEKKAPKQEKAKHEFLDKLYEMMIKDGFMKARDRNEKVVEFSYPEELKQKIDFDLGSKTSDEKILSLCQDIIKYSVKVAHPRFFNQLYGGLDEYSLGGCWLTETMNASLYTYEVSPVFSLMERVVIDKMLGKIGFEDGDAMFCPGGSISNMYALNIARYFKYPEVKKKGIKGIPDICAFTSEKCHYSIGKGVAFMGMGLDNLINVKTDANGKMIPEDLEKKILEAKAEGKTPYFVNATAGTTVFGAFDPIDEIADICQKYNLWMHVDGAWGGGALLSKTYSPLLKGVERADSMTWNPHKLMGVPQQCSLVFTKHKGLLEQCHSANASYLFQQDKFYDVSYDTGDKSIQCGRKNDVLKLWIMWKNKGDEGFERDIDNQFECAKYLAQLVQEREGFELMLEPQCTNVCFYYIPKRLRGLERTPEWWNEISKVGPKVKEGMMKAGSMMVGYQPDGDFVNFFRMIISNLDTVKSDMDFVVDEIDRLGKDL

SEQ ID NO: 196 - DNA, 23 bp, Issatchenkia orientalis
cgaaccaattcaagaaaaccaac

SEQ ID NO: 197 - DNA, 20 bp, Issatchenkia orientalis
ggtccttacatctgtctagt

SEQ ID NO: 198 - DNA, 25 bp, Issatchenkia orientalis
tgtatacaggatcgaagaatagaag

SEQ ID NO: 199 - DNA, 22 bp, Issatchenkia orientalis
gaacgtctacaacgaggtgaac

SEQ ID NO: 200 - DNA, 62 bp, Issatchenkia orientalis
cgttgtaaaacgacggccagtgaattcgttaaccattttgcacaagtagtagccagtcatcc

SEQ ID NO: 201 - DNA, 53 bp, Issatchenkia orientalis
ctgacaggaaccgatggactcgcggccgctttttctaatagggggaggggggg

SEQ ID NO: 202 - DNA, 63 bp, Issatchenkia orientalis
aataatatataattttataataaaagcggccgcgagtgtatacctccccgcttttgctgctac

SEQ ID NO: 203 - DNA, 79 bp, Issatchenkia orientalis
cagctatgaccatgattacgccaagctccgcggggacgaaaaaaatgaataggaaagtttttctcggaaggcaaagccg

SEQ ID NO: 204 - DNA, 24 bp, Issatchenkia orientalis
gctcacatacaagaaacggttcag

SEQ ID NO: 205 - DNA, 19 bp, Issatchenkia orientalis
gagatattgatccttctcc

SEQ ID NO: 206 - DNA, 20 bp, Aedes aegypti
ctcctccatcaagtcccgtg

SEQ ID NO: 207 - DNA, 23 bp, Issatchenkia orientalis
ctccgtgaatatcctcagtgctg

SEQ ID NO: 208 - DNA, 23 bp, Aedes aegypti
gaatgtaccaacgtctgcttctg

SEQ ID NO: 209 - DNA, 22 bp, Aedes aegypti
ggtgttacccttggagcagaac

SEQ ID NO: 210 - DNA, 10162 bp, Artificial Sequence
  ARTIFICIAL DNA CONSTRUCT
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgttaaccattttgcacaagtagtagccagtcatccattgttacaaacgggtagcagaactatggtgtcctttatgcaggatgaaatttggcaaaattcggattagcttcaattataatatgaatgatatttagtgtttagtaaaggttgtatttatataaaatatatagagtaaacactaaatccaataccattaaaatccttatgtgcggtagcacgctagaatggctaaaatgtaatggcgtaaatagccgttggcatgaccctcttcttgatagtggtgttattttagagaatcaaatcggggcgcatcgtaagggaaaccagtgcggacgcggcccaaaacggcaatgcgggagtgggggggggggtggtgcgttacttttctattttctattttttttttctttttcttttttttttttttttttcccccccccctgtttgcagcctctacgttgaaaataatgttcccacccccgggcgagacttctgcgggggggcatgagtgcgggaaacgccggagtccgttcggtggtattgttttacattttcgttattacccaacgggggctagtggtcttcaatgaggaagttctggaaattgtcggatagaaaatagtcccaattctattgttactaatggcgctagtgatattgttgcagtaaatggtcaattcccaattattccatacacggggtgcgtcggcgcgagggtagggtgatggttttcacctttggtgggcctcaatgtgagggtgggtggcatcatagtcaagataacaaattgtacaccaactcttataaaaggacacccatttgccgccatgtatattggttgatgtgtatttgttatttttccaattatattattttgtctttgatttttttattttagtttcttttaacatcaattaaatccaaacgaaccccccctccccctattagaaaagcggccgcgagtccatcggttcctgtcagatgggatactcttgacgtggaaaattcaaacagaaaaaaaaccccaataatgaaaaataacactacgttatatccgtggtatcctctatcgtatcgtatcgtagcgtatcgtagcgtaccgtatcacagtatagtctaatattccgtatcttattgtatcctatcctattcgatcctattgtatttcagtgcaccattttaatttctattgctataatgtccttattagttgccactgtgaggtgaccaatggacgagggcgagccgttcagaagccgcgaagggtgttcttcccatgaatttcttaaggagggcggctcagctccgagagtgaggcgagacgtctcggtcagcgtatcccccttcctcggcttttacaaatgatgcgctcttaatagtgtgtcgttatccttttggcattgacgggggagggaaattgattgagcgcatccatatttttgcggactgctgaggacaatggtggtttttccgggtggcgtgggctacaaatgatacgatggtttttttcttttcggagaaggcgtataaaaaggacacggagaacccatttattctaaaaacagttgagcttctttaattattttttgatataatattctattattatatattttcttcccaataaaacaaaataaaacaaaacacagcaaaacacaaaaagctagctaaaatgcctgcaaacggtatgttcgacgtcgcattgcaagttatcgacgactccaacgtctcctccggttccgactccgctggtgtctccgaagacgaagacgtccagttgttctgttccaagggtaacaccatcgtccctaagccattgaagaagtccatctccaagatcaaggacgaagaattctccaagaccgcaaaggcaaacgaaaagagatacgcttccttgccatccagagagcatcaccagcaattcttgaccgacttcttgtccgaagttttgaacaacgcagtcttcaacgctaccgagagagccaacaaggtcttgaactgggtcgacccagaacaattgaagagaaccttggacttggaattgaaggacgaaccagactcccacgaaaagttgttggagttgaccagagctaccatcaagcactccgtcaagaccggtcacccttacttcatgaaccaattgttctcctccgtcgacccatacggtttcgcaggccaaatcttgaccgacgctttgaacccttccgtctacaccttcgaagtctccccagttttcgtcttgatggaagaagtcgttttgaaggagatgagaaccatcgttggttacccagacggcaccggtgacggcatcttctgtccaggcggttccatggcaaacggttactccatctcctgtgcacgtttcaagcacatgccagacgtcaagaccaagggtttgcactccttgccaaggttggtcatcttcacctccgaagacgcccactactccgttaagaagttggcatccttcatgggtatcggttccgacaacgtctacccaatccacaccgacgcaatcggtaagatcagggttgaccacttggaatccgaaatcttgagagctaagtccgaaggtgctgtcccattcatggtctccgcaaccgctggcactaccgtcatcggtgccttcgaccctttggaacaaatcgccgacttgtgcaagaagtacaacttgtggatgcacgttgatgctgcgtggggtggtggtgcgttgatgtccaagaagtacagatccttgttgaagggtatcgaacgttccgactccgtcacctggaacccacacaagttgttagcggcaccacaacagtgctccaccttcttgaccagacacgagggtatcttgtccgaatgccactccaccaacgctacctacttgttccagaaggacaagttctacgacacccaatacgacactggcgacaagcacatccagtgtggtagaagagcagacgttttgaagttctggttcatgtggagagctaagggcacctccggtttggaacaacacatcgacaaggtcttcgaaaacgccgaacacttcacctcctccatcaagtccagagaaggtttcgaaatggttgtcgaaaacccagaatgtaccaacgtttgtttctggtacgttccaccaggtttgaggaacgtcccaagagactccgcagagttcaccgaaagattgcacaaggtcgcacctaaggttaaggaaagaatgatgagagagggttccatgatgatcacctaccaacctatccacgacaagccaaacttcttcaggttggtcttgcaaaactccgcgttggacaagtccgacatgaactacatcatcgacgagatcgaaagattggcagcagacttgtaaggcgcgccttctgtctttgattttcttatgttattcaaaacatctgccccaaaatctaacgattatatatattcctacgtataactgtatagctaattattgatttatttgtacataaaaaccacataaatgtaaaagcaagaaaaaaaataactaaggagaaggatcaatatctcatttataatgctcgccaaagcagcgtacgtgaattttaatcaagacatcaacaaatcttgcaacttggttatatcgcttcttcacccactcacccgcttttctacattgttgaacacaaatatatacaggggtatgtctcaaggtcaagtgcagtttcaacagagactacctcaaggtacctcttcagaaatgcagaacttcactcttgatcagattttctccgaattaaaggaggggccgcgagtccatcggttcctgtcagatgggatactcttgacgtggaaaattcaaacagaaaaaaaaccccaataatgaaaaataacactacgttatatccgtggtatcctctatcgtatcgtatcgtagcgtatcgtagcgtaccgtatcacagtatagtctaatattccgtatcttattgtatcctatcctattcgatcctattgtatttcagtgcaccattttaatttctattgctataatgtccttattagttgccactgtgaggtgaccaatggacgagggcgagccgttcagaagccgcgaagggtgttcttcccatgaatttcttaaggagggcggctcagctccgagagtgaggcgagacgtctcggtcagcgtatcccccttcctcggcttttacaaatgatgcgctcttaatagtgtgtcgttatccttttggcattgacgggggagggaaattgattgagcgcatccatatttttgcggactgctgaggacaatggtggtttttccgggtggcgtgggctacaaatgatacgatggtttttttcttttcggagaaggcgtataaaaaggacacggagaacccatttattctaaaaacagttgagcttctttaattattttttgatataatattctattattatatattttcttcccaataaaacaaaataaaacaaaacacagcaaaacacaaaaaactagttaaaatgcctgcaaacggtatgttcgacgtcgctttgcaagtcatcgacgactccaacgtctcctccggttccgactccgcaggcgtctccgaagacgaagacgttcaattgttctgttccaagggtaacaccatcgttccaaagccattgaagaagtccatctccaagatcaaggacgaagaattctccaagaccgctaaggcaaacgagaagagatacgcttccttgccatccagagaacatcaccaacaattcttgaccgacttcttgtccgaagttttgaacaacgctgtcttcaacgctaccgaaagagccaacaaggtcttgaactgggtcgacccagaacaattgaagagaaccttggacttggaattgaaggacgagccagactcccacgagaagttgttggaattgaccagagctaccatcaagcactccgtcaagaccggtcacccatacttcatgaaccagttgttctcctccgtcgacccatacggtttcgctggtcaaatcttgaccgacgcattgaacccttccgtttacaccttcgaagtttcccctgtcttcgtcttgatggaagaagtcgtcttgaaggaaatgagaaccatcgtcggttacccagacggcactggcgacggtatcttctgtcctggtggttccatggccaacggttactccatctcctgtgctagattcaagcacatgccagacgttaagaccaagggtttgcactccttgcctagattggtcatcttcacctccgaagacgctcactactccgttaagaagttggcctccttcatgggtatcggttccgacaacgtctacccaatccacaccgacgcaatcggtaagatcagagtcgaccacttggagtccgaaatcttgagagcaaagtccgaaggcgcagtcccattcatggtctccgcgaccgcaggcactaccgtcatcggtgctttcgacccattggaacagatcgcagacttgtgtaagaagtacaacttgtggatgcacgtcgatgccgcttggggtggtggcgctttgatgtccaagaagtacagatccttgttgaagggcatcgagagatccgactccgttacctggaacccacacaagttgttggctgctccacaacaatgttccaccttcttgaccagacacgagggtatcttgtccgaatgtcactccaccaacgctacctacttgttccaaaaggacaagttctacgacacccaatacgacaccggtgacaagcacatccaatgtggtagaagggcagacgtcttgaagttctggttcatgtggagggcaaagggcacctccggtttggagcaacacatcgacaaggtcttcgaaaacgctgaacacttcacctcctccatcaagtccagagaaggcttcgaaatggtcgttgaaaaccctgaatgtaccaacgtctgcttctggtacgtcccaccaggtttgaggaacgtccctagagactccgctgaattcaccgaacgtttgcacaaggtcgcaccaaaggttaaggaaaggatgatgagagaaggttccatgatgatcacctaccaaccaatccacgacaagccaaacttcttcagattggttttgcaaaactccgcattggacaagtccgacatgaactacatcatcgacgaaatcgaaagattggcagcagacttgtaattaattaatttattttactagtttatttttgctcctgagaataggattacaaacacttaaagtctttaattacaactatatataatattctgttggttttcttgaattggttcgctgcgattcatgcctcccattcaccaaaggtggagtgggaaataacggttttactgcggtaattagcagaggcaagaacaggatacactttttgatgataaatctgtattatagtcgagcctatttaggaaatcaaattttcttgtgtttacttttcaaataaataatgttcgaaaatttttactttactccttcatttaactataccagacgttatatcatcaacaccttctgaccatatacagctcaagatgtttaagagtctgttaaattttttcaatccatttcatggagtaccaggaggtgctacaaaaggaattcatagcctcatgaaatcagccatttgcttttgttcaacgatcttttgaaattgttgttgttcttggtagttaagttgatccatcttggcttatgttgtgtgtatgttgtagttattcttagtatattcctgtcctgagtttagtgaaacataatatcgccttgaaatgaaaatgctgaaattcgtcgacatacaatttttcaaactttttttttttcttggtgcacggacatgtttttaaaggaagtactctataccagttattcttcacaaatttaattgctggagaatagatcttcaacgctttaataaagtagtttgtttgtcaaggatggcgtcatacaaagaaagatcagaatcacacacttcccctgttgctaggagacttttctccatcatggaggaaaagaagtctaacctttgtgcatcattggatattactgaaactgaaaagcttctctctattttggacactattggtccttacatctgtctagttaaaacacacatcgatattgtttctgattttacgtatgaaggaactgtgttgcctttgaaggagcttgccaagaaacataattttatgatttttgaagatagaaaatttgctgatattggtaacactgttaaaaatcaatataaatctggtgtcttccgtattgccgaatgggctgacatcactaatgcacatggtgtaacgggtgcaggtattgtttctggcttgaaggaggcagcccaagaaacaaccagtgaacctagaggtttgctaatgcttgctgagttatcatcaaagggttctttagcatatggtgaatatacagaaaaaacagtagaaattgctaaatctgataaagagtttgtcattggttttattgcgcaacacgatatgggcggtagagaagaaggttttgactccgcggagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 211 - DNA, 10843 bp, Artificial Sequence
  ARTIFICIAL DNA CONSTRUCT
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattctttgaaggagcttgccaagaaacataattttatgatttttgaagatagaaaatttgctgatattggtaacactgttaaaaatcaatataaatctggtgtcttccgtattgccgaatgggctgacatcactaatgcacatggtgtaacgggtgcaggtattgtttctggcttgaaggaggcagcccaagaaacaaccagtgaacctagaggtttgctaatgcttgctgagttatcatcaaagggttctttagcatatggtgaatatacagaaaaaacagtagaaattgctaaatctgataaagagtttgtcattggttttattgcgcaacacgatatgggcggtagagaagaaggttttgactggatcattatgactccaggggttggtttagatgacaaaggtgatgcacttggtcaacaatatagaactgttgatgaagttgtaaagactggaacggatatcataattgttggtagaggtttgtacggtcaaggaagagatcctatagagcaagctaaaagataccaacaagctggttggaatgcttatttaaacagatttaaatgattcttacacaaagatttgatacatgtacactagtttaaataagcatgaaaagaattacacaagcaaaaaaaaaaaaataaatgaggtactttacgttcacctacaaccaaaaaaactagatagagtaaaatcttaagatttagaaaaagttgtttaacaaaggctttagtatgtgaatttttaatgtagcaaagcgataactaataaacataaacaaaagtatggttttctttatcagtcaaatcattatcgattgattgttccgcgtatctgcagatagcctcatgaaatcagccatttgcttttgttcaacgatcttttgaaattgttgttgttcttggtagttaagttgatccatcttggcttatgttgtgtgtatgttgtagttattcttagtatattcctgtcctgagtttagtgaaacataatatcgccttgaaatgaaaatgctgaaattcgtcgacatacaatttttcaaactttttttttttcttggtgcacggacatgtttttaaaggaagtactctataccagttattcttcacaaatttaattgctggagaatagatcttcaacgcgtttaaacagcaatttgaggaaggaataggagaaggagaagcaatttctaggaaagagcaaggtgtgcaacagcatgctctgaatgatattttcagcaatagttcagttgaagaacctgttggcgtatctacatcacttcctacaaacaacaccacgaattgcgtccgtggtgacgcaactacgaatggcattgtcaatgccaatgccagtgcacatacacgtgcaagtcccaccggttccctgcccggctatggtagagacaagaaggacgataccggcatcgacatcaacagtttcaacagcaatgcgtttggcgtcgacgcgtcgatggggctgccgtatttggatttggacgggctagatttcgatatggatatggatatggatatggatatggagatgaatttgaatttagatttgggtcttgatttggggttggaattaaaaggggataacaatgagggttttcctgttgatttaaacaatggacgtgggaggtgattgatttaacctgatccaaaaggggtatgtctattttttagagtgtgtctttgtgtcaaattatggtagaatgtgtaaagtagtataaactttcctctcaaatgacgaggtttaaaacaccccccgggtgagccgagccgagaatggggcaattgttcaatgtgaaatagaagtatcgagtgagaaacttgggtgttggccagccaagggggaaggaaaatggcgcgaatgctcaggtgagattgttttggaattgggtgaagcgaggaaatgagcgacccggaggttgtgactttagtggcggaggaggacggaggaaaagccaagagggaagtgtatataaggggagcaatttgccaccaggatagaattggatgagttataattctactgtatttattgtataatttatttctccttttatatcaaacacattacaaaacacacaaaacacacaaacaaacacagctagctaaaatgccagccaacggtatgttcgacgttgctttgcaagttatcgacgactccaacgtttcctccggttccgactccgcaggtgtttccgaagacgaagacgtccaattgttctgctccaagggtaacaccatcgtcccaaagccattgaagaagtccatctccaagatcaaggacgaggaattctccaagaccgctaaggcaaacgaaaagagatacgcgtccttgccttccagagaacatcaccagcaattcttgaccgacttcttgtccgaagtcttgaacaacgcagttttcaacgctaccgaaagagcaaacaaggtcttgaactgggttgacccagagcaattgaagagaaccttggacttggaattgaaggacgaaccagactcccacgaaaagttgttggaattgaccagggcaaccatcaagcactccgtcaagaccggtcacccttacttcatgaaccaattgttctcctccgtcgacccatacggtttcgctggtcaaatcttgaccgacgctttgaacccatccgtttacaccttcgaagtctccccagttttcgtcttgatggaagaggttgtcttgaaggagatgagaaccatcgtcggttacccagacggcaccggtgacggcatcttctgtccaggtggttccatggcaaacggttactccatctcctgtgcaagattcaagcacatgccagacgtcaagaccaagggtttgcactccttgccaagattggtcatcttcacctccgaagacgctcactactccgtcaagaagttggcttccttcatgggtatcggttccgacaacgtctacccaatccacaccgacgcaatcggtaagatcagagttgaccacttggaatccgaaatcttgagagctaagtccgaaggtgcagtccctttcatggtctccgcaaccgcaggcactaccgtcatcggtgcattcgaccctttggagcaaatcgcagacttgtgtaagaagtacaacttgtggatgcacgttgacgctgcttggggtggtggcgcattgatgtccaagaagtacagatccttgttgaagggtatcgagagatccgactccgtcacctggaaccctcacaagttgttagccgctccacagcaatgttccaccttcttgaccagacacgaaggtatcttgtccgaatgtcactccaccaacgcaacctacttgttccaaaaggacaagttctacgacacccaatacgacaccggtgacaagcacatccaatgcggtagaagggcagacgtcttgaagttctggttcatgtggcgtgcaaagggcacctccggtttggagcaacacatcgacaaggtcttcgaaaacgccgaacacttcacctcctccatcaagtcccgtgaaggtttcgagatggtcgtcgaaaacccagagtgcaccaacgtctgtttctggtacgtccctccaggtttgagaaacgtcccacgtgactccgctgaattcaccgagagattgcacaaggttgccccaaaggtcaaggaacgtatgatgagagagggttccatgatgatcacctaccaaccaatccacgacaagccaaacttcttcagattggttttgcagaactccgcattggacaagtccgacatgaactacatcatcgacgagatcgaaagattggctgccgacttgtaaggcgcgccatctaatagtttaatcacagcttatagtctattatagttttcttttttaaacattgttgtattttgtccccccccctctaattgatgatgattatcctataagaatccaataaaacgatggaaactaatactttctcctttgtcatgtggtctttagtatttcttgaacattggctctgatttctcgactttatagtcctattaaaatctctgttagttctcgatcgttgtatctcgtttcttgtctctttggtggatgattttgcgtgcgaacatgtttttttccctttctctcaccatcatcgtgtagttcttgtcaccatccccccaccccttccttctctcattgattctataagagcttatccacagaggtgcagtaacgaggtagtttaaccttcgagtggatcaaaatgtcacacaggaaacagcaatttgaggaaggaataggagaaggagaagcaatttctaggaaagagcaaggtgtgcaacagcatgctctgaatgatattttcagcaatagttcagttgaagaacctgttggcgtatctacatcacttcctacaaacaacaccacgaattgcgtccgtggtgacgcaactacgaatggcattgtcaatgccaatgccagtgcacatacacgtgcaagtcccaccggttccctgcccggctatggtagagacaagaaggacgataccggcatcgacatcaacagtttcaacagcaatgcgtttggcgtcgacgcgtcgatggggctgccgtatttggatttggacgggctagatttcgatatggatatggatatggatatggatatggagatgaatttgaatttagatttgggtcttgatttggggttggaattaaaaggggataacaatgagggttttcctgttgatttaaacaatggacgtgggaggtgattgatttaacctgatccaaaaggggtatgtctattttttagagtgtgtctttgtgtcaaattatggtagaatgtgtaaagtagtataaactttcctctcaaatgacgaggtttaaaacaccccccgggtgagccgagccgagaatggggcaattgttcaatgtgaaatagaagtatcgagtgagaaacttgggtgttggccagccaagggggaaggaaaatggcgcgaatgctcaggtgagattgttttggaattgggtgaagcgaggaaatgagcgacccggaggttgtgactttagtggcggaggaggacggaggaaaagccaagagggaagtgtatataaggggagcaatttgccaccaggatagaattggatgagttataattctactgtatttattgtataatttatttctccttttatatcaaacacattacaaaacacacaaaacacacaaacaaacacatctagataaaatgccagccaacggtatgttcgacgttgcattgcaagttatcgacgactccaacgtctcctccggttccgactccgctggtgtctccgaagacgaagacgtccaattgttctgttctaagggcaacaccatcgtcccaaagccattgaagaagtccatctccaagatcaaggacgaagaattctccaagaccgctaaggcaaacgaaaagagatacgcctccttgccatccagagagcatcaccagcaattcttgaccgacttcttgtccgaagttttgaacaacgcagttttcaacgctaccgaaagagcaaacaaggtcttgaactgggttgacccagaacaattgaagagaaccttggacttggaattgaaggacgaaccagactcccacgaaaagttgttggaattgaccagagcaaccatcaagcactccgttaagaccggtcacccatacttcatgaaccaattgttctcctccgtcgacccatacggtttcgctggtcaaatcttgaccgacgctttgaacccatccgtctacaccttcgaagtttccccagtcttcgttttgatggaagaagtcgttttgaaggaaatgagaaccatcgttggttacccagacggcaccggtgacggtatcttctgtccaggtggttccatggcaaacggttactccatctcctgtgcaagattcaagcacatgccagacgttaagaccaagggtttgcactccttgccaagattggtcatcttcacctccgaagacgcccactactccgtcaagaagttggcttccttcatgggtatcggctccgacaacgtctacccaatccacaccgacgcaatcggcaagatcagagtcgaccacttggaatccgaaatcttgagagccaagtccgaaggtgcggttcctttcatggtctccgctactgctggcactaccgttatcggtgcattcgacccattggaacaaatcgcagacttgtgcaagaagtacaacttgtggatgcacgtcgacgctgcttggggtggtggtgctttgatgtccaagaagtacagatccttgttgaagggtatcgaaagatccgactccgttacctggaacccacacaagttgttagccgcacctcaacaatgttccaccttcttgaccagacacgaaggtatcttgtccgaatgtcactccaccaacgcaacctacttgttccaaaaggacaagttctacgacacccaatacgacaccggtgacaagcacatccaatgtggtagaagggcagacgtcttgaagttctggttcatgtggcgtgccaagggcacctccggtttggaacaacacatcgacaaggttttcgaaaacgctgaacacttcacctcctccatcaagtccagagaaggtttcgaaatggttgttgagaacccagaatgtaccaacgtctgtttctggtacgtcccaccaggtttgagaaacgtccctagagactccgctgaattcaccgaaagattgcacaaggtcgcaccaaaggtcaaggaaagaatgatgagagaaggttccatgatgatcacctaccaacctatccacgacaagccaaacttcttccgtttggttttgcaaaactccgcattggacaagtccgacatgaactacatcatcgacgagatcgagagattggcagcagacttgtaattaattaacatctgaatgtaaaatgaacattaaaatgaattactaaactttacgtctactttacaatctataaactttgtttaatcatataacgaaatacactaatacacaatcctgtacgtatgtaatacttttatccatcaaggattgagaaaaaaaagtaatgattccctgggccattaaaacttagacccccaagcttggataggtcactctctattttcgtttctcccttccctgatagaagggtgatatgtaattaagaataatatataattttataataaaagcggccgcagagtgtatacctccccgcttttgctgctactaattaatacccactattaatttccttctattacaaaacgcctctcagactcccacacacacacttacatatgtacacgctcatacatacacttataaacatacatatatacgtcgacgatataattttaatgtcaatagccatgaacatttgaactactttcccgtttctctattttccggtttctttcccaaccgtcttttgtctttctttccacgtggctgacccaacgttttccattcacagagtgcattgtctattgtggaaaagcgggggtgagatttccacaaaacctgtacttctcacctcccccctccttaaccccggcccaagggggggggtacgcggcactgtagttaaggccgtacggagattttcccgggtgtcggcgtttagagacacacacaatagagagttttacttggaatacaatacacccccactctaattgtgtgttcatctcttctcctttcctctccgcttgtctcaagagccccgggggaatgtctgtgttttgttttgttatccaatattcacagacacttacctgattgtcgacgtttctccgataactgcgcatgttacatcattcttacacttttttcgtcattgtactgcttctatatttgtcggagatccactcggcacttctttccttcttactgtcccccctactacccaacaggaaaggagacagttgcagcacgtattggctatacatggtctgtccccaaggaacactctggttcttgttacctagaaacacccaaacgtatggtgcccttggcgtcgttggtgtgctccctggccatcaagacgctcggaaaaacaggttgttccagtctcacacactaccataccctagcggaacaaaataaaaaaaaagaatacaacaacatatttcttgtcgcagcacgtgactcgccggctttgccttccgagaaaaactttcctattcatttttttcgtcccgcggagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 212 - DNA, 1527 bp, Artificial Sequence
  Artificial DNA Sequence
atgagagttgattccaagatcattgtcaagaaagagactcaagacgaaaacttgtatcaatccttggccgaaagatccaagcacgaggagtttcttagaaaggcagtcgatctgttggttgagagagttgtttttggtagatctactagatcttctaaggtcgttgaatgggctgcaccagacgaaatcaagaaagcaattgatttgaagcctagattaggtccagcttcccatgatgaactcttggcgttcatggcaaatgtcgctagatattctgttaacactggtcatccatacttcgttaaccaacttttctcttcagttgatccatatggtttggtcggtcaatggttaaccgacgccttaaacccatccgtttacaccttcgaagtcgcacctgtcttcactttgatggaagaagaagttttgagggaaatgagaaagatcgtcggttggccagaaggtgaaggtgatggcattttctgtccaggtggttccatcgcaaatggttacgcaatttcttgtgcaagacaccacttttacccagaagttaagtacaaaggtgttcacgctgttcctaagttggttttgttcacgtccgagcttgctcactattccaccaaaaagatggcagcattcatgggtattggctccgacaattgtgtcaatatcaaaaccgatgatgttggtaagatgaacatcgttgatttggaaatgaagatcaagatcgcaattgataacaagtgtactccattcatggttaccgcaaccagtggtaccactgtctttggtgcattcgaccctttggttgcaattagtgacttatgtaagaagtataacttatggttgcacgttgacgctgcttggggtggtggtgccttgatgtctaagaagcatagacacttgttgaatggcattgaattggcagattctgttacttggaatccacataagttgcttgccgctccacaacaatgttctaccttcttaaccagacataagaaagtcttatctgaaggtcacagttccaatgccaagtatctgtttcaaaaggataagttctacgatacatcttacgacactggcgacaaacatattcaatgtggtagaagagcagacgtcttgaagttttggttcatgtggaaggcaaaaggtacagaaggtttcgaaaagcatgttgacaagctattcgacaacgcgaagtactttttggatcacatcaaacaaagagaaggttttcagctagttatcgctgaaccacaatgtaccaacattatgttctggtacattccaaagtgtctccgtggttgtgaaaacgatgcagattactatgagagactccacaaggtcgcacctaagatcaaagaacgtatgatcaaagaaggttctatgatggtcacctaccaaccacaaggtgacttagttaacttctttagaatcgttttccaaaactccgcattagatcacaaggatatggtttactttgcaaatgagttcgaaagattaggttccgacatgattgtttaa

SEQ ID NO: 213 - DNA, 1527 bp, Artificial Sequence
  Artificial DNA Sequence
atgagagttgactcaaagatcattgtcaagaaggaaacacaagatgaaaacctctaccaatctttagcagaaagatccaaacatgaagagttcttaagaaaggccgttgacttacttgtcgaaagagttgttttcggcagatcaaccagatcttccaaggttgttgagtgggctgcaccagacgagattaagaaagcaattgacttaaagccacgtttgggtcctgcttctcacgatgagttgttggcctttatggcaaacgttgctaggtattctgtcaatactggtcatccatacttcgttaaccagttattctcatccgttgatccatatggtttagttggtcaatggttaaccgacgcattgaacccatccgtttacacctttgaagtcgctcctgtctttaccttgatggaggaagaggttttgcgtgaaatgcgtaagattgtcggttggcctgagggcgaaggtgatggtatcttctgcccaggtggttctatcgccaacggttacgctatttcctgtgctagacatcacttttacccagaggtcaagtataagggtgttcatgctgttcctaagttagttttgtttacctccgaactcgcgcactacagtaccaaaaagatggctgctttcatgggtattggttccgataactgtgttaacattaagaccgatgatgttggtaagatgaacatcgttgatttagaaatgaagatcaagattgctattgacaacaagtgtaccccattcatggttacagctacctctggtactaccgttttcggtgctttcgacccattagtcgcaatctccgatctttgcaagaagtacaatctgtggttgcatgtcgatgctgcttggggtggtggtgctctcatgtctaagaagcacagacaccttttgaacggtatcgaattagccgactctgttacttggaaccctcataagcttttagccgctccacaacaatgttccacctttttgaccagacacaagaaagttctatccgaaggtcattcatccaatgcaaagtacttattccaaaaagacaagttttacgacacatcctacgacactggtgataaacatattcaatgtggtagaagagcagatgttcttaagttctggttcatgtggaaggctaagggtactgaaggtttcgagaaacacgttgacaagctttttgataacgcaaagtacttcttagaccacattaagcagagagaaggtttccaattggttattgcagaaccacaatgcaccaatatcatgttctggtacatcccaaagtgcctgagaggttgtgaaaatgatgcagactactatgagagattacataaagttgcgcctaagatcaaggaaagaatgatcaaggaaggttcaatgatggtcacctaccaaccacaaggtgatcttgttaacttctttagaattgtttttcagaactctgcattggaccataaggacatggtttacttcgcaaatgaattcgaaagattgggctccgatatgatcgtttaa

SEQ ID NO: 214 - DNA, 1527 bp, Artificial Sequence
  Artificial DNA Sequence
atgcgtgttgactccaagattatcgttaagaaagaaacccaagatgagaacttgtatcaatctttggcagaaagatccaagcatgaagagtttttgcgtaaagcagttgatctgttagttgaaagagttgtcttcggtagatctacaagatcttcaaaagttgttgaatgggctgcaccagatgagattaagaaagcaattgacttaaagccaagattaggccctgcatctcatgacgaattactagcctttatggcaaatgtcgctaggtatagtgtcaatactggtcacccatacttcgttaatcaattgttttcttccgtcgatccatatggtttggtcggtcaatggttgaccgacgcgctcaatccaagtgtttacacctttgaagttgcaccagtctttacgctcatggaagaggaagtcttgagagaaatgaggaagattgttggttggcctgaaggtgagggcgacggtatcttctgtccaggcggttctattgcaaacggttacgcaatttcttgtgctagacaccacttctacccagaggttaagtacaagggtgttcacgcagttccaaagttggtcttgtttacctcagaattggcacactattctacgaagaagatggctgcctttatgggtattggtagtgataactgtgttaacatcaaaaccgatgacgttggtaagatgaacattgttgatttagaaatgaagattaagatcgcaattgataacaagtgtactccattcatggttactgctacttccggtacaacggttttcggtgcttttgatccattagttgctatttccgatttgtgtaagaaatacaatctatggcttcatgttgatgctgcgtggggtggtggtgctttgatgtccaagaaacacagacacttattgaacggtattgaattagccgactctgtcacttggaatcctcataagttgttagcagctccacagcaatgttccaccttcttaactagacacaagaaagtcttgtccgaaggccacagttccaacgcaaagtacttgttccaaaaggacaaattctacgatacctcttacgacactggcgataagcatatccaatgtggtagaagagcagatgttctgaagttttggttcatgtggaaagctaagggtactgaaggtttcgagaaacacgtcgataaactattcgataacgccaagtatttcttggatcatatcaagcaaagagagggtttccaattagtcattgcagagcctcaatgtaccaatatcatgttctggtacattccaaagtgccttagaggttgtgaaaacgatgcagattactatgaaagactacataaggttgcgccaaagatcaaggaacgtatgattaaggaaggttctatgatggttacctaccaaccacaaggtgatttggttaacttcttcagaatcgtcttccagaactctgctcttgatcacaaggatatggtttacttcgccaacgaatttgaacgtttgggttccgatatgattgtttaa

SEQ ID NO: 215 - DNA, 1527 bp, Artificial Sequence
  Artificial DNA Sequence
atgagggttgactccaaaatcatcgtcaaaaaggaaacccaagatgaaaacttgtaccaatctttggctgaaagatccaagcatgaagagtttttgagaaaagccgttgatttgttggttgaaagagttgtttttggtagatccactagatcctccaaggtcgttgaatgggcagctccagatgaaatcaaaaaggccatcgatcttaagcctaggttaggcccagcttcccatgatgaattgttagcctttatggcaaatgttgcaagatattccgtcaatactggtcacccatacttcgttaatcaattgttttcatctgttgatccatacggtctagttggtcaatggttgaccgatgccttaaacccttctgtctatacctttgaagttgctccagtctttacattgatggaggaagaggttttgagagaaatgaggaaaatcgttggttggccagaaggtgagggtgatggcatcttttgtccaggtggttctatcgccaacggttacgctatttcttgtgctcgtcatcacttctacccagaagttaagtacaaaggtgttcatgctgtccctaagttagtcttgtttacctctgaattagctcactattctacaaagaaaatggctgcattcatgggtattggttccgacaattgtgtcaatatcaaaacagacgacgttggtaagatgaacattgttgacctagaaatgaagattaagatcgcaattgacaacaagtgtacccctttcatggttacagctacatcaggtactactgttttcggtgcttttgacccacttgtcgcaatctccgatttgtgtaagaagtacaacttatggctacatgtcgatgcggcatggggtggtggtgcgttaatgtcaaagaagcatagacatcttctaaacggtatcgaattagcagactccgttacctggaatccacacaaattgttagctgctcctcaacaatgttccacattccttaccagacacaagaaggtcctgtctgaaggtcattcttccaacgccaaatacttgtttcagaaggacaagttttacgacacttcttatgacactggtgacaaacatattcagtgtggtagaagagcagatgttttgaagttctggtttatgtggaaggcaaagggtacggagggtttcgagaagcacgttgataagttgtttgacaatgctaagtacttcctagatcacattaagcaaagggaaggtttccaattggtcattgcagaacctcagtgtaccaacatcatgttctggtatatcccaaagtgtctaagaggttgtgaaaatgatgcagactactatgaaagattgcataaagtcgctccaaagatcaaagaaagaatgatcaaagaaggttctatgatggtcacctaccaaccacaaggtgatttggtcaatttctttagaatcgttttccagaattctgctttagatcataaggatatggtctactttgcaaacgaattcgaaagattaggttccgacatgatcgtttaa

SEQ ID NO: 216 - DNA, 20 bp, Issatchenkia orientalis
ggtccttacatctgtctagt

SEQ ID NO: 217 - DNA, 20 bp, Issatchenkia orientalis
acagcggacgaagatccttc

SEQ ID NO: 218 - DNA, 22 bp, Issatchenkia orientalis
cctggtcaagtattgccaacag

SEQ ID NO: 219 - DNA, 1647 bp, Artificial Sequence
  Artificial DNA Sequence
atgccagcaaacgaagaaaccttgtctatgacttccgatcagattagaaacaacttgttaggtaaagcctgtgacgactctatgcaaaacaactttgattgtgaatcttccggtgatgatgaggaagactaccaaaacgattgctccagatcaattgttaaggaaaacttcaaggaggtttgtaactacaaatctttacctgttagagaaatccacaagaaattcatgaagtcctttgtcaacttgttattggaagaagctgtcttcgaaggcaccctcaggagaaacaaagtcgtcgaatggattgaacctactactttacactccatcattgacttaaagttatccgatcaaggttgttcttatgaaaccttgttaaccttggcacataacgtcattaagtattcagttaagactggccatccaagattcattaaccagttatactcctctgttgacccatacggtttgttaggccaatggcttaccgatgccttgaatccttccgtttacacctacgaagtttctcctgtcttctccttgatggaagaagagattttgagagaaatgagaaagattgttggttggaaggatggtagatccgaaggcatcttctgtccaggtggttctattgcaaacggttatgcaatcaacttagcaaggtactataagtttccacagtcaaaggaattaggtctgtttaacacaggtagattgatcattttcacttcaagagacgctcattactctgttaagaaattgtcagctttcttgggtatcggtacagaaaatgtctatgaagttaagaccgatgataagggcaaaatgtgtatcaccgaccttaagatccagattaagaaggcactagaagaagatgcaattcctttgatggtttctgcaactgcgggtacaactgtcttaggtgccttcgatccattgaagaacattgcagctatttgcaagaactacaatttgtggtttcacgttgatgcagcatggggtggtggtgccttgatgtccaaaaagtacaaatacctattagatggtattgaattggcagactctgtcacttggaaccctcacaagttattggcagcacctcagcaatgttctacccttttgctaagacacgaaggtttgttacaagatgcacatggttctaaggcttcttacttgttccagccagacaaattctacgatacctctttcgattcaggtgacaagcatatccaatgcggtagaagggcagacgttttgaaattctggttcatgtggaaagcaaagggtactagaggtcttgaaaagcatgttgacagagtcttcaagttagcaagatactttaccaattacattaagcatagagagggcttcaaattgatccttgaacctgaatgcacaaacgtttgtttttggtatgtcccaccatctaaaagacaattacagaacgaagaattgctcaaggctttgcaaaagatcggtccagcagttaaggagagaatgatgaagaaaggttcaatgcttatcacttaccaaccattaagggaacttccaaacttcttcagattagttctgcagaattccggtcttactgaaaccgacatgagattcttcgctgaagagattgaaagattggctattgatctctaa

SEQ ID NO: 220 - DNA, 1647 bp, Artificial Sequence
  Artificial DNA Sequence
atgcctgcaaatgaagaaactttgtccatgacttccgatcagattagaaacaacttgttaggtaaggcctgcgatgattctatgcagaacaactttgactgcgagtctagtggtgatgatgaagaggattaccaaaatgattgttccagatctattgtcaaggaaaactttaaggaagtctgcaattacaagtctttgccagtcagagaaattcacaaaaagttcatgaaaagttttgttaacttattgctcgaagaagctgtctttgaaggtacccttagaagaaacaaggttgttgaatggattgagcctactacattacattcaatcatcgatttgaagttgtcagatcagggttgttcctacgaaaccttgttgactttggctcataacgtcattaagtactctgtcaaaaccggtcacccaaggttcattaaccagttatactcctccgtcgatccttacggtcttttaggtcaatggttaaccgacgctcttaacccaagtgtctatacctacgaagtttctccagtcttctcattgatggaagaagagatcttgcgtgaaatgagaaagattgttggttggaaagacggtcgttccgaaggtatcttttgcccaggtggttctattgcgaacggttacgccatcaatcttgccaggtattacaagtttcctcaatctaaggaattgggtttgtttaacaccggtaggttgattatcttcacctccagagacgctcattactctgtcaaaaagttatccgccttcttaggtattggtacagaaaatgtttacgaagtcaaaacagatgataaaggtaagatgtgtatcacagatcttaagattcagatcaaaaaggctttggaagaagatgctatcccacttatggtttctgcaacggctggtacaaccgttttgggtgcctttgacccattgaagaacattgctgccatttgcaaaaactacaatttgtggttccatgttgatgcagcatggggtggtggtgccttaatgtcaaagaagtacaagtacttactcgacggtatcgaactagcagattcagttacttggaatccacacaagttacttgcggctcctcaacaatgttccacattgttattgagacatgaaggtttactccaggacgctcacggttctaaggcttcctatttgttccaaccagataagttttacgatacatcttttgactctggcgacaagcatatccaatgcggtagaagagcagatgtcttgaaattctggtttatgtggaaggcaaaaggtacaagaggtttagaaaagcacgttgatagggtctttaagcttgctagatacttcaccaactacatcaaacatagagaaggcttcaagttgatcttagagccagaatgtaccaatgtttgtttctggtacgttccaccaagtaagagacaattacaaaatgaagaattgttgaaggctctccagaagattggtccagcagttaaggaaaggatgatgaagaaaggttctatgttgatcacctatcaaccattgagagaactcccaaacttctttagattagttcttcaaaactcaggtttaactgagacagatatgaggttctttgcagaagaaatcgaaagattggcaatcgatttataa

SEQ ID NO: 221 - DNA, 1647 bp, Artificial Sequence
  Artificial DNA Sequence
atgccagcgaatgaggaaactttatccatgacctccgatcagattagaaacaacttattgggtaaggcttgcgatgattctatgcagaacaactttgattgtgaatcatctggtgacgatgaagaagattatcagaatgactgctccagatctattgttaaggagaacttcaaggaagtttgtaactacaaatctctaccagttagagaaattcacaagaagtttatgaaatcttttgttaacttacttcttgaagaggcagtcttcgaaggcactttgagaaggaataaggttgttgaatggattgaacctactaccttgcactccatcattgacttaaagttgtcagatcaaggctgttcctatgagaccttgttgaccttagctcataacgttatcaagtactccgttaagactggtcacccaaggttcatcaatcagttgtactcttctgttgatccatatggtttgttgggtcaatggcttaccgatgcattgaatccatccgtctatacttatgaagtctctccagtcttttcattgatggaagaagagatcttgagagaaatgagaaagattgttggttggaaagatggtagatctgaaggtatcttctgcccaggcggttccatcgcaaacggttacgccattaacttggcaaggtactataagttccctcagtctaaggaattgggtctcttcaatactggtcgtctcatcattttcacctccagagatgcccactattcagtcaagaagttatccgcattcttgggtattggtacagaaaatgtttacgaagttaagaccgatgacaagggcaagatgtgcattaccgatttgaagatccagattaagaaggcactagaagaagacgccatcccattgatggtttctgcaaccgcaggtaccactgtccttggtgcttttgatccactcaagaacattgctgctatttgtaagaactacaacttatggttccatgttgatgcagcttggggtggtggtgcgttaatgtccaagaagtacaagtaccttcttgatggtattgaattagcggactcagttacatggaatcctcacaagctactcgcagcaccacaacaatgttccactttgttattgagacacgagggcttattgcaagacgcacacggttccaaggcatcttacttattccaaccagataagttctatgacacctcatttgattcaggtgataaacacattcaatgtggtaggagagcggatgttttgaagttttggttcatgtggaaagccaagggtaccagaggtttggaaaagcacgttgatcgtgtcttcaaactagctaggtatttcaccaactacatcaaacacagggaaggtttcaaattgatcttagaaccagaatgtacgaatgtttgcttttggtacgttccaccatctaagaggcagctccaaaatgaggagttgttaaaggcattgcaaaagattggccctgctgttaaggaaagaatgatgaagaaaggttccatgttaatcacttatcaaccattaagagaactcccaaacttcttcaggctggtcctgcagaactctggtttgactgaaaccgatatgaggttctttgcagaagaaattgaacgtttagcaatcgatttataa

SEQ ID NO: 222 - DNA, 1647 bp, Artificial Sequence
  Artificial DNA Sequence
atgccagccaacgaagagactttatctatgacatccgaccagatcaggaacaacttgttaggtaaggcctgtgacgattctatgcaaaacaacttcgattgtgaatcatctggtgatgatgaagaagattaccaaaatgattgctccagatcaatcgttaaggagaatttcaaggaagtttgcaactataagtccttaccagttcgtgaaattcacaagaaattcatgaagtcctttgttaacttgttattggaggaagcagtttttgagggtactttaagacgtaacaaagttgtcgagtggattgaaccaacaactttacactctatcatcgatttgaagttatcagatcaaggttgttcatacgaaaccttattgaccttagcccataatgtcattaagtattcagttaagactggtcacccaaggtttatcaatcaattgtactcttccgtcgatccatacggtcttttgggccaatggttaaccgatgccttgaatccatctgtctatacctacgaggtttctccagtcttttcattgatggaggaggaaatcttaagagaaatgagaaagattgttggttggaaggacggtagatccgagggtatcttttgcccaggtggctccattgcaaacggctacgccatcaatcttgcaaggtattacaagtttccacagtctaaggaattaggtttgtttaacacaggtagattgatcattttcacctccagagacgcgcactactccgtcaaaaagttgtctgctttcctaggcatcggtacagagaatgtttatgaagttaagaccgatgataagggtaagatgtgtattaccgacttgaagatccagatcaagaaagctttagaagaagatgcaattcctctcatggttagtgcaactgcgggtaccactgtcttaggtgcatttgatccattgaagaatatcgctgcaatctgcaaaaactacaacttgtggttccacgtcgatgctgcatggggtggtggtgccttaatgtccaagaagtataagtacctacttgacggtatcgaattggccgattctgtcacttggaacccacacaagttattggctgcccctcaacaatgttccactttgttgttgagacatgagggcttattgcaagatgctcatggtagtaaggcatcctatttgtttcaaccagacaagttctacgatacctccttcgattctggtgataaacacatccaatgcggtagaagagccgacgtcttaaagttttggttcatgtggaaggctaagggtaccagaggtcttgaaaagcacgttgacagagttttcaagcttgctaggtactttaccaactacattaagcacagagaaggctttaagctcatcttagagcctgaatgtaccaatgtctgtttctggtatgttccaccatcaaaaagacaattgcagaatgaagaactattgaaggcacttcagaagattggtccagcagtcaaagaaagaatgatgaagaagggtagtatgttgattacctaccaaccacttagagaattgccaaacttctttagattagttttacagaattctggtttgactgaaacggatatgagattcttcgctgaagaaatcgaacgtttagctattgatttgtaa

SEQ ID NO: 223 - DNA, 1728 bp, Artificial Sequence
  Artificial DNA Sequence
atgttggcttccgaaaacttcccaacccaccacttcaaggagtccatcttcaagccatactccactacctccggtgacgacttggcttccgtttccccattgaccgctaccgctgctttggtcgcttccacctcctcccctgcagactccacctccaccgtcgcattcgaacaagcttccaagatgttggccaatgctgccaacaacaacaacaacaacaacaacaacatcacctccaccaaggacgacttgtcctccttcgtcgcttcccacccagctgctgagttcgaaggtttcatcagagcatgtgtcgacgaaatcatcaagttggcagtcttccaaggtaccaacagatcctccaaggtcgttgaatggcacgaaccagcagaattgaggcaattgttcgacttccaattgagagagcaaggtgaatcccaagacaagttgagggaattgttgagagaaaccatcagattctccgtcaagaccggtcacccatacttcatcaaccaattgtactccggtgttgacccatacgctttggtcggtcaatggttgaccgacgcattgaacccatccgtctacacctacgaagttgcgcctttgttcaccttgatggaggaacaagtcttggcagaaatgagaagaatcgtcggtttcccaaacggtggtcaaggcgacggcatcttctgtccaggtggttccatcgcaaacggttacgctatctcctgtgcaagatacaggcactccccagaatccaagaagaacggtttgttcaacgctaagccattgatcatcttcacctccgaagacgctcactactccgtcgagaagttggcaatgttcatgggtttcggttccgaccacgttagaaagatcgctaccaacgaggtcggtaagatgagattgtccgacttggaaaagcaggttaagttgtgcttggaaaacggctggcagccattgatggtctccgctactgcgggtactaccgttttaggcgctttcgacgacttggcaggcatctccgaagtctgtaagaagtacaacatgtggatgcacgtcgacgcagcatggggtggtggtgctttgatgtccaagaagtacagacacttgttgaacggtatcgaaagagccgactccgttacctggaaccctcacaagttgttagccgcatcccaacaatgttccaccttcttgaccagacaccaacaagttttggcacaatgtcactccaccaacgctacctacttgttccaaaaggacaagttctacgacacctccttcgacaccggtgacaagcacatccagtgtggcagaagagcagacgttttcaagttctggttcatgtggaaggctaagggtacccaaggtttggaggctcacgtcgaaaaggttttcagaatggcagagttcttcaccgcaaaggttagagagagaccaggtttcgaattggtcttggagtcccctgaatgtaccaacatctccttctggtacgttccaccaggtttgagagaaatggaaagaaacagagagttctacgacagattgcacaaggtcgcacctaaggtcaaggagggtatgatcaagaagggctccatgatgatcacctaccaaccattgagacaattgccaaacttcttcagattggtcttgcaaaactcctgtttggaagaatccgacatggtttacttcttggacgaaatcgaatccttggcccaaaacttgtaa

SEQ ID NO: 224 - DNA, 1728 bp, Artificial Sequence
  Artificial DNA Sequence
atgttggcttccgaaaacttcccaacccaccacttcaaggaatccatcttcaagccatactccactacctccggtgacgacttggcttccgtctccccattgaccgcaaccgctgcattggtcgcgtccacctcctccccagcagactccacctccaccgtcgctttcgaacaagcctccaagatgttggcaaacgctgcaaacaacaacaacaacaacaacaacaacatcacctccaccaaggacgacttgtcctccttcgtcgcttcccacccagctgccgagttcgaaggtttcatcagagcttgtgtcgacgaaatcatcaagttggccgtcttccaaggtaccaacagatcctccaaggtcgttgaatggcacgaaccagcagaattgagacaattgttcgacttccaattgagagagcaaggtgaatcccaagacaagttgagagaattgttgagagaaaccatcagattctccgttaagaccggtcacccatacttcatcaaccaattgtactccggtgttgacccatacgcattggtcggtcaatggttgaccgacgccttgaacccatccgtttacacctacgaagtcgcacctttgttcaccttgatggaagaacaagttttggctgaaatgagaagaatcgttggtttcccaaacggtggccaaggtgacggtatcttctgtcctggtggttccatcgcaaacggttacgctatctcctgtgctcgttacagacactccccagaatccaagaagaacggtttgttcaacgctaagcctttgatcatcttcacctccgaagacgctcactactccgtcgaaaagttggcaatgttcatgggtttcggttccgaccacgttagaaagatcgctaccaacgaagttggtaagatgagattgtccgacttggaaaagcaggtcaagttgtgcttggagaacggttggcaaccattgatggtctccgctaccgctggtactaccgtcttgggtgctttcgacgacttggctggtatctccgaagtctgtaagaagtacaacatgtggatgcacgtcgacgctgcatggggtggtggtgctttgatgtccaagaagtacagacacttgttgaacggcatcgagagagcagactccgttacctggaacccacacaagttgttagccgcatcccaacagtgttccaccttcttgacccgtcaccaacaagtcttggctcaatgtcactccaccaacgctacctacttgttccaaaaggacaagttctacgacacctccttcgacactggcgacaagcacatccaatgtggtagaagagcagacgttttcaagttctggttcatgtggaaggcaaagggtacccagggtttggaagcacacgtcgagaaggtcttcagaatggctgagttcttcaccgccaaggtcagagaaagaccaggtttcgaattggtcttggaatccccagaatgtaccaacatctccttctggtacgttcctccaggtttgagagaaatggaaagaaacagagagttctacgacagattgcacaaggtcgctccaaaggtcaaggaaggtatgatcaagaagggttccatgatgatcacctaccaaccattgagacaattgccaaacttcttcagattggttttgcaaaactcctgtttggaagagtccgacatggtttacttcttggacgaaatcgaatccttggctcagaacttgtaa

SEQ ID NO: 225 - DNA, 1728 bp, Artificial Sequence
  Artificial DNA Sequence
atgttggcttccgagaacttcccaacccaccacttcaaggaatccatcttcaagccttactccactacctccggtgacgacttggcttccgtctcccctttgaccgctaccgcagccttggttgcatccacctcctccccagcagactccacctccaccgtcgcgttcgagcaagcttccaagatgttggcaaacgctgcaaacaacaacaacaacaacaacaacaacatcacctccaccaaggacgacttgtcctccttcgttgcctctcacccagcagcagagttcgagggtttcatcagagcatgtgttgacgaaatcatcaagttggcagtcttccaaggtaccaacagatcctccaaggttgtcgaatggcacgagcctgcagagttgagacaattgttcgacttccaattgagagaacagggtgagtcccaagacaagttgagagaattgttgagagaaaccatccgtttctccgtcaagactggtcacccatacttcatcaaccaattgtactccggtgtcgacccttacgcattggtcggtcaatggttgaccgacgcattgaacccatccgtctacacctacgaagtcgcaccattgttcaccttgatggaggaacaagttttggctgaaatgagaagaatcgttggtttcccaaacggtggtcaaggtgacggtatcttctgtcctggtggttccatcgcaaacggttacgcaatctcctgtgctagatacagacactcccctgaatccaagaagaacggtttgttcaacgctaagcctttgatcatcttcacctccgaagacgctcactactccgtcgaaaagttggccatgttcatgggtttcggttccgaccacgttagaaagatcgctaccaacgaagtcggtaagatgagattgtccgacttggaaaagcaagttaagttgtgtttggaaaacggttggcaaccattgatggtctccgcaaccgctggtactaccgtcttgggtgcattcgacgacttggcaggtatctccgaggtttgtaagaagtacaacatgtggatgcacgttgacgctgcatggggtggtggcgcattgatgtccaagaagtacagacacttgttgaacggtatcgaaagagcagactccgtcacctggaacccacacaagttgttagccgcatcccagcagtgttccaccttcttgaccaggcaccaacaagttttggcacaatgtcactccaccaacgcaacctacttgttccaaaaggacaagttctacgacacctccttcgacaccggtgacaagcacatccaatgcggtagaagagcagacgttttcaagttctggttcatgtggaaggcaaagggtacccaaggtttggaagcacacgttgagaaggttttcagaatggcagagttcttcaccgctaaggtccgtgaaagaccaggtttcgaattggtcttggaatccccagaatgtaccaacatctccttctggtacgtcccaccaggcttgagagaaatggaaagaaacagagagttctacgacagattgcacaaggtcgctccaaaggttaaggaaggtatgatcaagaagggttccatgatgatcacctaccaacctttgagacaattgccaaacttcttcagattggttttgcaaaactcctgtttggaagaatccgacatggtttacttcttggacgaaatcgaatccttggctcaaaacttgtaa

SEQ ID NO: 226 - DNA, 1728 bp, Artificial Sequence
  Artificial DNA Sequence
atgttggcttccgaaaacttccctacccaccacttcaaggaatccatcttcaagccttactccactacctctggcgacgacttggcatccgtttccccattgaccgcaaccgcagcattggtcgcatccacctcctccccagcagactccacctccaccgtcgccttcgaacaagcctccaagatgttggcaaacgcagcaaacaacaacaacaacaacaacaacaacatcacctccaccaaggacgacttgtcctccttcgttgcatcccacccagctgctgagttcgagggtttcatcagagcatgcgtcgacgaaatcatcaagttggcagtcttccaaggtaccaacagatcctccaaggtcgttgaatggcacgaacctgccgagttgagacaattgttcgacttccaattgagagaacaaggtgaatcccaagacaagttgagagaattgttgagagaaaccatcagattctccgtcaagaccggtcacccatacttcatcaaccaattgtactctggcgtcgacccatacgccttggtcggtcaatggttgaccgacgctttgaacccatccgtctacacctacgaggtcgctccattgttcaccttgatggaggagcaagttttggcagagatgagaagaatcgtcggtttcccaaacggtggtcaaggtgacggtatcttctgtccaggtggttccatcgcaaacggttacgccatctcctgtgctagatacagacactccccagaatccaagaagaacggtttgttcaacgcaaagccattgatcatcttcacctccgaagacgcacactactccgttgaaaagttggcaatgttcatgggtttcggttccgaccacgttcgtaagatcgcaaccaacgaagtcggcaagatgagattgtccgacttggagaagcaagtcaagttgtgtttggaaaacggttggcagcctttgatggtttccgctaccgctggtactaccgttttgggtgctttcgacgacttggcaggtatctccgaagtctgtaagaagtacaacatgtggatgcacgtcgacgcagcttggggtggtggcgctttgatgtccaagaagtacagacacttgttgaacggtatcgaaagagcagactccgttacctggaaccctcacaagttgttggcagcatcccaacagtgttccaccttcttgaccagacaccaacaagttttggcacaatgtcactccaccaacgcaacctacttgttccaaaaggacaagttctacgacacctccttcgacaccggtgacaagcacatccaatgcggtagaagagcagacgtcttcaagttctggttcatgtggaaggccaagggtacccaaggtttggaggcccacgtcgaaaaggttttcagaatggcagagttcttcaccgcaaaggtccgtgaacgtccaggtttcgaattggttttggagtccccagagtgtaccaacatctccttctggtacgttcctcctggtttgagggaaatggaaagaaacagagagttctacgacagattgcacaaggttgctcctaaggttaaggagggtatgatcaagaagggttccatgatgatcacctaccaacctttgagacaattgccaaacttcttcagattggtcttgcaaaactcctgtttggaggaatccgacatggtctacttcttggacgaaatcgaatccttggcacaaaacttgtag

SEQ ID NO: 227 - DNA, 24 bp, Artificial Sequence
  Artificial DNA Primer
gtttgtaatcctattctcaggagc

SEQ ID NO: 228 - DNA, 29 bp, Artificial Sequence
  Artificial DNA Primer
gagagggaagtgtcatgcgtagcatactc

SEQ ID NO: 229 - DNA, 37 bp, Artificial Sequence
  Artificial DNA Primer
cattaggcaaataaaggagcgatgatctttatcttgg

SEQ ID NO: 230 - DNA, 1001 bp, Issatchenkia orientalis
cccatgcactcaactatccccgtaaacatagtagtaggctataggctttcttctcgtcatcacagagaagccatatagagacatatacatattaatacatggacttctaggcttactttctcacatacttttcacgtactttctcacatatttactaatacacaatttttacattatgtgcatttgtaaattgcaatgtaggattttcctcattgacaaggacaaaccctcatttgggaggaaaagagaaaataacttctccgtttttttttgtttttttttctcagatgagccgccactgttttttttttttttgcatccccctttttccaatttgtcatgactataaaagcgcgaattccccccccccccttgtctcccgtttctttcctgccatgcgagattgctcattcaatttgaccttctcttgatgtggcaatttatctccaaaactgacagcttaagcttctttccaatgttggtttctggtaaacgaatgccatagagaaaggctggagatacagagacaggtctgtggttgtttcccacacgggtttgtttttgattctcctcgacatggtttgtctgctgaatatatataaatattcatacacctctatctaactatctatctataaaaaatcgcaatgtagtagctatattaacattaactatggcaataataacaatagcaatactgaaaacaatgatgttattattattatcgtgggcaataccaaaaaccgaggtcattcaaaagggcgcacattggtggaaaaacaatacttgcgcggaaaaaaaaaaattaatatctgccaaatcctaaactgcaaatcatggattgcaattctccgttatctatataaggctaggaggttgccaatcggtatataatagttgggggggaggaggaggaggattctctttagattatcacttgatacaaatcaatcggttatcttttattgaaaagtcaagacacaaaccaaccaactaaacga

SEQ ID NO: 231 - DNA, 1020 bp, Issatchenkia orientalis
caacttggttcaaaccaagaaagccgtcgtgtactttgcgtattttcaacttcttcccttcaactccaaccttataacccaatccgacagttagcatacagtagaaaatccataagttaattgcaaaaaccacataattcccaatgactggcacaatttgcatgaacggcgcaaaaccaacacctatccttcttgacttgtggacaacttctccggcatcggctccagtttctggtttaggcgacactttcaaggtacccttgttgactaggttctcagcaacatactcctcctcgataactttgaccgtctttgtgccaaacacattgttcaatagtttggacgctcgcataccgaagacagactcgtccatccaatagcatgtactccgaatgctctcaatcaacggtatcaaatcgcttggtgtctttggaggcggtgttctaggtttcatcttcgccttcccgtttcctgtttcttggacttcaaaatacgggtcatatgcatcttcattggtgaacctgaacagtttgggccgagtagtgccaaacaccttcaacagtataatcttcactccttggccgattagaaacatgcttatatgtttgccggtattcttaaagtgtatactggagcccttttaatcacattttttttacttgtcagtctccatacggagtttaatgtccttatatcgatcttcatcagctccaacgggacaggaatcaataaccttccttgcctgtcccaaaaagaatgaattttttttcaaaagctttacgatgcataccacaaaaggaagattattcccacatgttccagaagtgtgcggagatacaaagggttcatgaaaacgtgaatcttctaaaaacttagcacaacaataaaaatctacaatgttacagtaagtattattttctttttgtcgacacactccaacggttagatttccaagtattcaatccaatgtattacttgtcagacagccatccactcccatcttagaacatcacttccgaa

SEQ ID NO: 232 - DNA, 1623 bp, Artificial Sequence
  Artificial DNA Sequence
atgcctgctactggcgaagaccaagacttggtccaagacttgatcgaagaaccagctaccttctccgacgctgtcttgtcctccgacgaggagttgttccaccaaaagtgtccaaagcctgcaccaatctactcccctgtttccaagccagtttccttcgaatccttgccaaacagaagattgcacgaagagttcttgagatcctccgtcgacgttttgttgcaagaagccgtcttcgaaggtaccaaccgtaagaaccgtgtcttgcaatggagagagcctgaggagttgagaagattgatggacttcggtgtcagatccgctccatccacccacgaagagttgttggaagtcttgaagaaggttgttacctactccgttaagaccggtcacccttacttcgtcaaccaattgttctccgctgtcgacccatacggtttggttgcacaatgggcaaccgacgctttgaacccatccgtttacacctacgaggtctcccctgttttcgttttgatggaagaggttgttttgagagaaatgcgtgctatcgttggtttcgaaggtggtaagggtgacggtatcttctgtccaggtggttccatcgcaaacggttacgctatctcctgtgcaagatacagattcatgccagacatcaagaagaagggtttgcactccttgccacgtttggtcttgttcacctccgaagacgctcactactccatcaagaagttggcctccttccaaggtatcggtaccgacaacgtctacttgatcagaaccgacgcaagaggtagaatggacgtctcccacttggtcgaagagatcgaaagatccttgcgtgagggtgccgctccattcatggtctccgcaaccgctggtactaccgtcatcggtgccttcgacccaatcgaaaagatcgcagacgtctgtcaaaagtacaagttgtggttgcacgtcgacgcagcctggggtggcggtgctttggtctccgcaaagcacagacacttgttgaagggtatcgagcgtgcagactccgtcacctggaacccacacaagttgttgaccgcaccacaacaatgttccaccttgttgttgagacacgaaggtgtcttggccgaagctcactccaccaacgcagcttacttgttccaaaaggacaagttctacgacaccaagtacgacaccggtgacaagcacatccagtgcggtagacgtgcagacgttttgaagttctggttcatgtggaaggctaagggtacctccggtttggaaaagcacgttgacaaggtcttcgaaaacgcaagattcttcaccgactgtatcaagaacagagaaggtttcgagatggttatcgctgagcctgaatacaccaacatctgtttctggtacgttccaaagtccttgcgtggtagaaaggacgaggccgactacaaggacaagttgcacaaggttgctccacgtatcaaggaacgtatgatgaaggaaggttccatgatggttacctaccaagctcaaaagggtcacccaaacttcttcagaatcgttttccaaaactccggtttggacaaggcagacatggttcacttggttgaggagatcgaaagattgggttccgacttgtaa

SEQ ID NO: 233 - DNA, 1623 bp, Artificial Sequence
  Artificial DNA Sequence
atgccagcaaccggtgaagaccaggacttggttcaagacttgatcgaggaaccagctaccttctccgacgctgtcttgtcctccgacgaagaattgttccaccaaaagtgtccaaagccagctcctatctactccccagtttccaagccagtttccttcgaatccttgccaaacagaagattgcacgaagagttcttgcgttcctccgtcgacgtcttgttgcaggaagccgtcttcgagggtaccaacagaaagaacagagtcttgcaatggagagaaccagaggagttgcgtagattgatggacttcggtgtccgttccgctccatccacccacgaagaattgttggaagtcttgaagaaggttgtcacctactccgtcaagaccggtcacccatacttcgtcaaccaattgttctccgctgttgacccttacggtttggtcgctcaatgggctaccgacgcattgaacccatccgtctacacctacgaagtctccccagtcttcgttttgatggaagaagttgttttgcgtgaaatgagagcaatcgtcggtttcgaaggtggtaagggcgacggtatcttctgtccaggtggttccatcgcaaacggttacgcaatctcctgtgctagatacagattcatgccagacatcaagaagaagggtttgcactccttgccaagattggttttgttcacctccgaggacgcacactactccatcaagaagttggcctccttccaaggtatcggtaccgacaacgtttacttgatcagaaccgacgcaagaggtcgtatggacgtctcccacttggtcgaggaaatcgaaagatccttgagagaaggtgccgctccattcatggtttccgcgaccgcaggtactaccgttatcggtgctttcgacccaatcgaaaagatcgcagacgtctgtcaaaagtacaagttgtggttgcacgtcgacgcagcttggggtggtggtgccttggtctccgctaagcacagacacttgttgaagggtatcgaaagagcagactccgtcacctggaacccacacaagttgttgaccgcaccacagcaatgttccaccttgttgttgcgtcacgaaggcgttttggcagaagctcactccaccaacgctgcctacttgttccaaaaggacaagttctacgacaccaagtacgacaccggtgacaagcacatccagtgcggtagaagagcagacgtcttgaagttctggttcatgtggaaggcaaagggcacctccggtttggaaaagcacgttgacaaggtcttcgaaaacgctagattcttcaccgactgtatcaagaacagagagggtttcgaaatggtcatcgcagaaccagagtacaccaacatctgcttctggtacgtcccaaagtccttgagaggtagaaaggacgaagcagactacaaggacaagttgcacaaggtcgctccaagaatcaaggaaagaatgatgaaggaaggttccatgatggtcacctaccaagctcaaaagggtcacccaaacttcttcagaatcgtcttccaaaactccggtttggacaaggcagacatggtccacttggtcgaagagatcgagagattgggttccgacttgtaa

SEQ ID NO: 234 - DNA, 28 bp, Artificial Sequence
  Artificial DNA Primer
cacagcaaaacacaaaaagctagctaaa

SEQ ID NO: 235 - DNA, 28 bp, Artificial Sequence
  Artificial DNA Primer
ttaattaatttattttactagtctgcag

SEQ ID NO: 236 - DNA, 26 bp, Artificial Sequence
  Artificial DNA Primer
cacacaaacaaacacagctagctaaa

SEQ ID NO: 237 - DNA, 31 bp, Artificial Sequence
  Artificial DNA Primer
ttaattaacatctgaatgtaaaatgctgcag

What is claimed is:

1. A recombinant yeast cell comprising a heterologous polynucleotide encoding an aspartate 1-decarboxylase, wherein the aspartate 1-decarboxylase has at least 95% sequence identity to the amino acid sequence of SEQ ID NO: 162, and wherein the cell is capable of producing 3-hydroxypropionic acid (3-HP).

2. The recombinant yeast cell of claim 1, wherein the aspartate 1-decarboxylase comprises a glutamine at a residue corresponding to position 377 of the amino acid sequence of SEQ ID NO: 162.

3. The recombinant yeast cell of claim 1, wherein the aspartate 1-decarboxylase comprises a $F_1aa_{19}S_2aaY_3$ motif or an $Y_1aa_{19}S_2aaY_3$ motif, wherein $F_1$ is phenylalanine, $Y_1$ is tyrosine, $aa_{19}$ is an intervening sequence of nineteen amino acids, $S_2$ is serine, aa is a single amino acid, and $Y_3$ is tyrosine.

4. The recombinant yeast cell of claim 1, wherein the heterologous polynucleotide encoding the aspartate 1-decarboxylase comprises a promoter foreign to the polynucleotide encoding the aspartate 1-decarboxylase.

5. The recombinant yeast cell of claim 1, wherein the cell produces a greater amount of 3-HP compared to the cell without the heterologous polynucleotide encoding the aspartate 1-decarboxylase, when cultivated under identical conditions.

6. The recombinant yeast cell of claim 1, wherein the cell belongs to a genus selected from *Candida, Issatchenkia, Kluyveromyces, Pichia, Saccharomyces, Schizosaccharomyces, Torulaspora,* and *Zygosaccharomyces*.

7. The recombinant yeast cell of claim 6, wherein the cell is selected from *I. orientalis, C. lambica,* and *S. bulderi*.

8. The recombinant yeast cell of claim 1, wherein the cell is capable of growing at a pH of less than 4 in media containing 75 g/L or greater 3-HP.

9. A method of producing 3-HP, comprising:
(a) cultivating the recombinant yeast cell of claim 1 in a fermentable medium under suitable conditions to produce 3-HP; and
(b) recovering the 3-HP.

10. The method of claim 9, wherein the fermentable medium is at a pH of less than 5.

11. A method of producing acrylic acid or a salt thereof, comprising:
(a) cultivating the recombinant yeast cell of claim 1 in a fermentable medium under suitable conditions to produce 3-HP;
(b) recovering the 3-HP;
(c) dehydrating the 3-HP under suitable conditions to produce acrylic acid or a salt thereof; and
(d) recovering the acrylic acid or salt thereof.

12. The recombinant yeast cell of claim 1, wherein the aspartate 1-decarboxylase has an amino acid sequence comprising or consisting of SEQ ID NO: 162.

13. The recombinant yeast cell of claim 1, wherein the aspartate 1-decarboxylase has at least 97%, sequence identity to the amino acid sequence of SEQ ID NO: 162.

14. The recombinant yeast cell of claim 1, wherein the aspartate 1-decarboxylase has at least 99%, sequence identity to the amino acid sequence of SEQ ID NO: 162.

15. The method of claim 9, wherein the aspartate 1-decarboxylase has at least 97%, sequence identity to the amino acid sequence of SEQ ID NO: 162.

16. The method of claim 9, wherein the aspartate 1-decarboxylase has at least 99%, sequence identity to the amino acid sequence of SEQ ID NO: 162.

17. The method of claim 9, wherein the aspartate 1-decarboxylase has an amino acid sequence comprising or consisting of SEQ ID NO: 162.

18. The method of claim 11, wherein the aspartate 1-decarboxylase has at least 97%, sequence identity to the amino acid sequence of SEQ ID NO: 162.

19. The method of claim 11, wherein the aspartate 1-decarboxylase has at least 99%, sequence identity to the amino acid sequence of SEQ ID NO: 162.

20. The method of claim 11, wherein the aspartate 1-decarboxylase has an amino acid sequence comprising or consisting of SEQ ID NO: 162.

* * * * *